United States Patent 10,407,724 (METHODS AND COMPOSITIONS FOR SCREENING AND TREATING DEVELOPMENTAL DISORDERS) - sequence listing, part 70

SEQ ID NO: 1863 - DNA, 2092330 bp, Homo sapiens
tgtaacataactgcgtgctttattgagatacacagtaaagcagtactataatacaatagtaaggcatatatttggtgaagtctgatatgttgtgaaaatgcagtaaaactgaagtttaaaaaaataattcgtaaatgttacagtgttggtgttaaaacacaatatattatgatactcaagtaagaactcagtacctgaaaacaatgacaaaacatgccatgtgatgtttatgcttcagttacattatgatttacagtttaatacttggtggttataaagaacacaacacgaaataatgtccaaattaattatgcttaaaatgcagcaataaagctctcaatttttgttcaaatattatgacagactcactccagagctaatgtgtctaaaagaaaaacaaaaagattaaaacaaaattatttatgcactctatttacctctgattttagaatgaaacttacttacttaaacttcttagtaggatgtaaagtaaccccttgttttaaatctgagttttaaaaatccttgggtaaagaaaaggtccagcgtcacataaaggaaaaaaatgcaagacaaaaaccaaatcttcatgtaatttggtaatttgttaccttagagctttgggttttcttttgaaaattatgaaggaaaaagaaagaattataaaggaaaaagaaaataacgcaatggacaagtggtgaagctgtgaactcaggtgtgcacaattatcaggaacaccccaaaaccaaagtgaggtagaaatagcatgagaagccgtgtttgatgttaattaattaattattaataatggacaaaacccactctccaaaagctaattacacttgatgtcagcccactctccaaaagctaattacacttgatgtcagaggtaacagatttgcaaaattataggtcacacggtggtatctattgaatgaatgatttaaaaatcaaaaagaaataaaatggcatgaaagagtaaagctttttcctaccagtccttagcttttcctcttgagcttttctcctcttttttgagcaatttttgtttgtttgtttatatatttaacctgtctaatccaccaagaagggtttttttgtaacatttgaatcaatttgccttctttcttacttacttacaaacctgtgtggaactactcgcagagaaatgcaaaggatggaaacacagttcatgggcttctgggttgatacctgtcagtatcacaaatgtgatggggctactgttttacaccttttcccaaagtttatttattttaaattatgtcttgtggcatttaaaaactcatcccacatgggacaataaatctaaaaaagcaacaaaaaccaaaccacccagttccttttgactgtgagaagagggcataataatttagttgtaattacagagaactttatgtattatgaacaatcatccaatccttcacttaaagagtggcctactccttcacagggatgggctgggaatccatagccctccagccctatcatcgtcctgctactgcttgggagttaaaaaataccttctgatgttcacaaggtcagaataccttctgattgatttccactgaagcatcattaaatctaaatcgtggcattgctagcagcaggaagctgaatgtatcaatcaatcaatcaatcaaccaaccaaccgattactcactctgatataataagtcctgtgtattcattcacatgttccctttaaaaaaatccaatactttactttactttcgttgtcagtggaaagttgtttaaaatgagaaacatctggagctgtagacaatgttttagtgtggtgtagtttcctcctggcttccggctccgggaaaaatccattctagaccaagcaggtaagcctggatgactgactagaagtaatttctttctattaggatgtgacatgaacatttaaaaaatggaaaaagtcagtctatagaaattcgtatctctttatctatataactatagtatttatatacttatagacatatagatatatgaaatgaaaactcaagcctgccccactcagctgacagttctcaaatgagcagtgtgtagtagtcatttggtgtggtggtagaggaagtcttatctttaatatgcaaaaaaagaaaaagccatgaatttcatatggatatcacgccaaaaggatgcaaaacaatgcgctgcctcaaagttttgtgtgtgtgtgtgtatgtgtgtgtgtgtgtgtttgttttgtttttaggggtttttataaacaacttttttttataaagcacactttagtttacaatctttctttataactgttataaatttttaaacaacccaaaatgcgttccatataaagaaatggcaagttatttagctatcaagattttacatgtagttttcttataacttttttgtacaattgcatagacgtgtaaaacctgccattgttaacaaaacaataacagacttagaaactactgaaatctacagtataataccactacccttcacaaaaatatagatttatttcttgtaaactcttactgtctaatcctctttgttgtatgaatattataaaaaccatgcgggaatcaggagttgtaaaacatttattctgctccttcttcatctgtcatgactgatactaaggactccatcgctctgcccaaatcatctgccatgtggaaaagacttcctacattgtgtcctggaaaacaaagagaaagaaagacagactttacaaaaggtgcagatagatagcatcactctgtttctttgccatttgggaaatcattccccatttctgggtgaagacaacacagaagctgcatcgagggtgtacacaacaaggtttgatttttcaccagtttccaggaagaagcaaagccttattaatgaagccattacacgttgtttgttagtatcagcttaatgttggatcaggctactggtgtttacatggaaaaatgtcaagctacattcaggttcccaatgtaaatatatatcaaaagaattccatagataagcacaagatttctatcagaacaggaatattccatgatgggatacatcttttccaccttggctatgagtgattgattgattacttactctctacttgtattaacgaacattttttttactatcaatcaaaccaccatcaccaccttcacaactaccactaccatcaccagcacccaaccatcgtcaccattatcactgccaccatcaccgccacaccaacttttcatttcaaagctgtttcaggctgttggcttgcttctgaggctatggtggaggtggctattttctctctgcttttacttgggttgaaaaataataataataaactcttgaattgaccttttggtgcactattaacatttgaattaggaaacctcagaataaaaattgctttacattccaaattactctagaccctaattataaggtgacccacatgtattgtatgcatttgggtattttgtgaatccatcttagagctcctcctaaatgagggttaactatcacaatagccttttactaataatgcagcacgacctagcacgaatctcccagcacggagaaaaagaacagcacaatgtccctgggtacttcgtagcaaaattcagatttagagtaagataatctgagacttactttatggcttgccttttcgtctatgtcccatagttttacatggctaattttaattattgcacattggtaaatccttccactattcaagtattgtctttggaactgaaatgctttactaggctattactaccttgccatgtatcaactttacagattcccataataattgttaaaaataccaataaaaattaaagatatcccaataaaaattaaagctatagactagggagagtattttgttttaatatttatttcaagagatatagcttctctacaaaatgaagcggattcacgggcaggcacttaaacagtgatggcaccagatcaactgaagacttacttattaaaagtttaatgtcattcaggcatttctattaaggtgaccaagtttgtatatctatctttttgtgctttattagtgcaaagaatttcatggagtattaattatattttagaaaatcactttggattttggctgagactgcaagtataaaaattttttaacaaagcatatgcaactattcataaagtgggccaatagtttggcagccctcagtgaagaactgaaatcatttttggctttctgtgccataaaaaccacaggaagacgacacagtggggcctttgctgctccttagagctcagagtacaaatatataactgctgctatcaagttggagggcttcccctgtatctatttttggctgtccagcaaccctgggaaatctgcataattattcatgcataaattgaagatagatggactaactgccaatttttaattactagcgatctttacggttaacaaaatcagtaaaaacaaagtccaggacctttacaacatggtgcctgaatgtaattcgaagtatttctcatggcccacatgtgactatagtatgtagtccacctagtagctagaaaacatattacaaaacatcaacgaaaaggggagaaaactcattttttttcctgtcagcttatcgataatcacaaagtgtctttctttttaggctgtgtgctaggggatgtagatggcagttcaaaatataataaaacaaataaatgcatttatggattatatagccaagtggtgcttctcttccttgaaatggtgttcagttactaactggaaggaaaattcttgagtctctcaagaagcataagttctaggggtatctgctatttaaagatttgccagggaaaacaggttcattattcttaatgtgccatgcacactccgacaaaaagttgggtggcctttaaccggtttacactgctgcattttcacaaatgaccttgtggccatctttgtgctataaaaataaagaacttttagagtcacctcatcatctatattatgcctttggttacttcactaaatacctgctttaccagaataaataattctaatttctttccatggagtttttcattagatccagaaaaaagaagtcaatctctttttacaaactactgccctaaagaatcatactttaatccgttggaggggtaagactgcactgtgacatgactatagaaagtagatttgtatcctagttctattatccatgtgtgtaaggcagagcattcgggaggtcattaatgttacctgacagatttttctaaagtcaaaattacaatctcatactatgaagtatgagaggtactgaaaagcagccaggattcaggcatttgcaatcaccttcaggcacaaggtgacagaaaactatgtctatagaaagtattgatttaatccattcttaaggattattgaacacaaaggcactatgccttgaacattagggcagttgtatgtttttcaagttggcgctaactgcaacacatttagtctcacacgtcaccactgcctgagggaattgttttccacagcgattggaattgagactttctggcaaagatccaagacctcaatagcaatctggtgctctattttttaaaaatacaattcccaaataaattgttagcattcagttgtccaaaggaaagccggaatactacagggaaatttgcttatcttttcttctctataatttaatctctgaaaaaaatctgctttacgtacatttgggatattttcatagcattaaaaaaggtcattattgttttgattctttggcttctggaaacttgtctgaacaccatacacctcaggtagtcaagtctgcaaatgcctatataacttcaattacatgtgctagccttttctgaaattcatttgtgagtgaaacatgtttaaggtggtcaaaattatggtgcatttttctacaaaaagttaaaatgaataaattttaaggggcacttaccataagaatgaacccaagaagtctcacatacgaagtacatgaaccaggcaaaccgtcaggggcattcaatgcttcaccaagtcaggtttcctcaatttctcctcccagcctaccattccctccctggccccactgcccaaagccttggaaggaggcactggcacagacacactgaagaatcattaaattgattagacttgtatggcatgatgttggcagagttttcattacgactcctgtgtttaaatgaatcagtggtctctccagtccatcctgttgctaaggaatccagaatcttctcatttaagaaggactctccacccatccagcctgtctcccagaacactgtcatcccatgggagagctttccttctctcctccttcagattaaattcttggtaaagacaaccttgattttacttgggctgtcagttaacactttgtcatccaacagtcacttaattaggtaattcgatattcagacaatattcctggtggaataggagtaagaagcatctttcaccgtaaaacctgaaaccacattcagtgataagactgcaccctatccctttcaacccataaataggcattttaaaaacctctcaaaactccaatatttaattttttaatcgaattggttattgttctgtgtggcttcaaataccaaataaaaaagatcatcttctgaagggtacgttgagatgatgtaagcctttcaaatgagagttaagagtgtgggtctggagccagactgcctggatccaaatccttggctctgtcacctgggacacactgcttactctctcattgactcagtctccttatctgtaaaacggggttaataagagtacctacctcacaggtttgtcatgaagatgacatgatgaaaaagatggcaagtgctgagaacaatgcttggcacacagtaagtgctcaaaaaatgttcgctaaaatgggagagaaagagcgtaggaaccaagaaaaaaggaaacaaaagcaaaatgaagtcatcccagaagaataaaaactaagggcgctggcagaaaatgctaaggtcctggaagtggaagaaagctttatgactcatcagttatgttcaaggctaaatttattttgaagattttgttagtgttgcaaatggcaacagatgatgaacggcaggattccaacctagggactacaaaggattgccattttaaagagattcttgctcccaaccccagtcttgtcgtcatggtgatgacaacggcaatgaacatttgaggaatgttcctcatgagctgcaagtggagaggtgactaccatccttacatgatgacacaatgtgtaatacacacatgcgcgtgcacacacacaattcttacacaaacgccaaacataaaaagcaggatgagacagacagaagccatggccgtgagcctgaatctcactaacctctctcattggctttccaggggtatttcttcctttaataatagagagaggaagaggcagagatatcagaaagggaaaaaaaacatgcataaatatacaatttcataccaatttgcttcttttaccaaacaaatgttgagatgaccatttattctctgctggaaaaaaaaaaaaaaaaaaaaacagaaacaaaaaacccaaaagacacatctagtcaaataacctttacatacacttaagatcagtgtaaacagataacatgatccagaagacgtcatttgtaaaatccatagagttcacgcattaaactggatgaaaactggcacagaatagaaatctgacaaattgggcattgttttcaaggacaactcaaacttaatgttaaaaaaagtctcagaatctcttcactcttgacaatcagcacattgaaacataaacagtagttgactctgtgtgcccaaagtctgcacatcaaatgcaaggtagaacccgacatagaggctggactccatcctcttgggagaatttgttctatctgatagaagctgagcatttccatgatgaaattggaggcatttgagaaaacagaaagaacagatgaggggaagaggtaagtcccagtaatgggcaagccacagagccagatccaggaatgagctttccacttcctccccaattcagcaaatatcaggagccttacgaggcaatggctaaagacccactggccttgattcatagattcctacatctgtatgcatttatttgtatttcaaaagtagactctgatgagaaagtgttctatgataagtcataattggacagaaaagtagggacttctgtccatacatgtcaatagcctgtcttgggcatgcaatttcctttaaaatcttggttttcaaactgttttaactatagcaatgggacatctcctaaaacaatcttatatggaattccaatattttgagcagttcaaagcagagctgtgagagatcctgtacagcatctccctttcccctccacccatcattctcagtggctccaagaagactaaaaactccctgaaacaatttgagaactactagtctggaatgaagaggtatggagctacgacaccaatagaaacctttcaaaactcactcaaggttagggttcaaaacttctagtatacatttaaggatagtttctaagtttttcttccctctctccttctctttcttccctccctttctccttctctcccttcctctcttccttctgaatttcctacatgactcagcgatttcttaggagtatcagattttcagcttgaccacgtaagggccaggtatttaagatgctcctcaagccagggaaaagagggagaaaaatgggtactagctcctcagctgtgggtgtcactagtgggagatccataccaaatgatgttcccatcatttggggaggagaacatcattctttccttgatggctgaaatcccagtatgaatcactcaccccttctttttgattcctttagcaaggtttttttaaaaaagtatctttatgtttcataatactgtctggtggcagaattaattcccttcccctgtaagactataagcctcttgaggacggggtccacatgttgctcatccacctctctatgcccaatgccctgtaccgtatatacacacttttggtatttgataaatactggctgaagtgaattggtaaagtagtagttgggtcatgaccaagaggagtccttctgtgttataagtaacttgcccttcactggcacactttagtttggatgccaaaggtgggtaacttgtttcggcatgtaactttggtctagttttgaaaacttgagatctttaggaaggacagtgttgttagaaagccatgtgatttagaatgtaattatggttatgtacttcagaatgtaacgatgattctttgaatgcttaatgatacatatctttagtaattctacactaagccatattcagaactcagttatcaattgattatttcttaatatgtagcagcaaatgacttgtgttatgttccagatccttcttcagaaaccatattttatgaaaatggacctcccagagccaagctaactctaatctcttctaaaatcctccctcatcacttgggtccccacgtactcattaacacattacaaaaggaaggtcctttttttcactttagaaaaagttaaaaacaaatgatattttctactgtaaaaggactagttctacgctgacaaaacagaggctacttgattacaacatttttaaaagttcttgaccgataaataaagtttcagatatgtttcattttctaaacatttatttttttttggaaatgagtttctgtagaccttcagttacagtgtccatctggcaatgtgatgtgttgtcaggaaatgaatcaagacaaaagggaagtgtgctggggcagtcctgagtctaaataaagggcttggtcaggtcccgagaagtctaatttcctcgggcactataaaattgacattattgattgtaattcattattttagagttggaattgcaggacagtactgtttctgggtgcttttagcctcttttatattaattcactgactatttaaaatacttaaggaagaataagtccctttttaggatttctgttattttataagtcaaaaaaattcaaatggccacacttgcaggctctttggtgaatatgaatataaatctataaatcaattcaatttcagctcaataatcttgttcagctgaaagttgatcagcacagaagcctgtgactctatacatgtaatgagtcagaatggacaacgaaataatagcgtaaagcagggattggcaaattttccccataaagggccagatagtaaatatttcaggctttgcaagcccacggtctctggaccagctattcagcactgctgcaactactctgccctggtaatgagaaagcaactataggcaacatgtaaatgaatgggtatggctgtgttccaataaagctttataaaaacaggtattgggccagatttggcatttgggctgtatgtagtttgctagtcctggattaaagggataaccgctcaaatcctttgtgggagcatacaggaaacagaatggtgcctgaaaaagggcacaccatatttctatctgcctttgttctttatgttgctcttccataaaagaaccacagaataagattttaattttaaaagacggtaggttttacaaagctgttgggttggtaatttaggggtatttgatagaatgtacgcgggcttatttgagaggggatggtatgaaaaaaagaggatggcatgggctggtggagataatgtggcacaggtcagtaggcaagagattgtacaggtagcagaaatagtagcactgctaactgctttctggattgttttactgcattaagagcttatcttggctcctattattcattcatctatataaagtggtaccacattttagagagcctaataccatactactgactaggagagcgtttctttcatcaatgcacatacatataaaaatatctttgttagtctgctaaatgatcagagacttatggacaaatcacttaatggggttattttttaaattacgtttgtttattgtacccatgtagttttcctatagaatggcagagctttagagagtaccttatagtaaagtagataatgacttattacactataattcaatttctacacatatacttacaaaggaagagattagagatagacagattagatagaaattggctaatattcagtgttcaaatatacactgagccactcaaatctcccaagtgtttgtgaacaactaagtatatctagagaccaaccagaaagatataatcacaaagctgaatgtttacacattcatatcttgaatatgctcctgcttatattgcctattatgcaggatagtgttggccatcggtttatcactaaatggagaagcatgccactcatttattaattttgataacagtttagcaaagccattaagataagattagaagcctaacttaacctgctgaatggccataaataaggcacttgacttttcttggcttccaggtactctttgtgaaaataaaagataaagaaaggttagctgacaccttcaggaccaactctgtggcaaggggcaacagaaaagttgtaaatttgaggtacataatagcttacctatctatatactttatgtttatgaagagcataagttttttaaaaacggcttttcctctgtgggcaattatctagcagggttaagtaaaccacgcggtggtatttaatagcacatttccactaaatgtcagacctctggctctcacatctgttttgagttactcaaacagctgtccaaaacagctgtagcaatcatgaactttgttttttgtaacacaacaatgagaacatggatggtagtgttagaataaaactataaaggtctctgagacattagcaacgtcttggcagaaacttccacggcaaaaatctcaaaatttaaatttttttgaaagataattcaaccaggcaagaaaaactgagatcacatagattagtatttttaaaccactggttcagaaaatccatttagtgggttgcaaccagcattttgtttttaaataaataaaatagaaaaacagcatgcactgtatgtagtatggaaggcatcacttgatgaaacttttgtttctgatctttgtatgcatatgacactgtaaatgtgtgtgtgtacatatggtgggtgtatatatacatgtgtgtacataaacacatgtacaatttattttatatctttaccccagtttgtgatgtaaaatgttcctctgatatggataaccatcaaaacagagtcagaaatcactgtcctggatgtcaaaagtgttaaaatgacctttcaaggctcttccatttgaaagactttgtaatcccaagatgttaagattctcaagaatttctgcttaatatcagctgaacacatctaccaactggtaagatgttcccgccaaacttgacggtatatgtgtgtgtacacacacatatgccatttttcaaaattaaaaaacaaaagtgcttttagttggaaagaaagcatccaaaaaccacttttttgagtgcatcaataattagcctaatttttacaataatgaaactttttatccacttgaatttggggagaaaaaggcctgtaagaaagcctgagttagctgaaagtagcaaaacgtgaggaaatgccaagatcatggtattacagaatgataggccagattttccaataccttagctactctcttgtgttttttgtgtatttaattgttttgttttttaagaatgtgaatttattttctcaggccacaagggtaccactgagtaagccggaacttaagttaatggaattggtatcggacaaggcttccttctcccacatttgagaacttaaatcagcccttaaggcctgaaattcttccgtaagcactaatttagtaaacactatccaggtggcctgaattgagtttcccaagtttccatacaagtaagtaaatcaacatcagagatactgactgctaaataccatatcagaggaggtatatttcttgtcttccaggaagcttctacacccatgtggtatctagctttaaggactctaaaagcgggacacagggagatggtgcaaaggatttcaccttacagctaattagggtggaccagaaactcaggtacaaaaaggagtctaggaagtcaaggctgcctatgaagaagcagagtcatgagccttgctgtagcttcttctctactaacctcttgtttagatgtggaagaaatgcccagggtgccaacagggcagccagcaactttccagagcaggtaagcaagctgccagttcaaggggccaggatcatacagtaatcaatgattgtactgtgatttgaatttctttggagttctgtatctgcaattgaccataagtaccttgaaggcaaggaatttgtcatttcttctttccatccctactacctccactggtacgtagtaggtgctagtaaaagcaagcaggacaaagtaatgaggagacacgtgaaagcacctgattctgtcaagcctgtgtatgatcttctcattatgaattatgacatctagaagaaggagatacctaagatagtcagaatggggatgcgggtggcggtgggggatgtggaggtgggtggaagacagataagatttttatctgttaaaatcatcacttcagtggcgctcagcagtgaaaagatggctggtgcagacatttaaaattagcttcccctgacggttccttagcaacgctctaccagaacattattgcttttaatgtgcactgcacaacgtttacttgcacatcaaatagctaggaaatggccattgttaactgacactgaacaaaaagataggaaaaacacactactcaatacaccctcctcattgcccttatggagaggaacaaacagcccagatttcctgctgcccgtccctcccaggctacccattagaggtgccaatcactggccacaaagccttgtgttttctcccttttgtttctctaggcttttcttctatttgatcacaggtgactgccaccatcctttttattcgttgaaggaaggcgagagagtgactttgttttatgtgagggcaataaaccaaataaatgcccccagaaacgaacagtagcagcaaaacatcatcttggatgaagcaagacatctgaagctcatgcaagccagtgggaaaattctgcagggtaaaatgctgtttttgtatgggggtaaaatacgcaaggccaaagtgatgaagaaaaagaaaaatattaatgtctttctttgctaagcctgtatttcctctatcgaagtaaaaaataaccaactactctatgaagatttaattgtccctatatttaaatgatggagtaagatacaatttttaaatataaagggcatcagatggcaagtcagaatctctaccactaccaatcagtaggcattgttctaggccttgctgtagcacgtagtagccatatgtccctggcaaaggcactatcagggcattaatttcctcatctgtaaaagtcacataataattgctcttcagtaaagggcacctcataattaactcttcagactaatgtgtgaagcaagtaaaatacttgacaaatagagggtggtattcttatttttggaaacatgttgccctcacgggtatttgaattcagagtactctaaaccacaaattcacacttaaaaatcaaatcttttcaccatggacccaaattgccattctgatactgcgtgttggcttccatatggaaaatacacacaccagttgggtagggaagcgagtggcctgatcccagcaaatctgagtcccttctaggtattggagcttacctcttgaactagggaaggagttgttgagttgctccatcacctcctctaaccctgtgcttgtgtcctggggaggactgagaagatcttcctcaccttaataaaagcaaaaacaaataatggaaaattacatttatagaaaacagatattaaagggccatgattacatttttaacaccattataaattcatttcacttgctcataaataacaaagaaaaccctcaagcttaataatgaggaagtaattctttaaagggaagaagaaatccatacagtagtttatctatatcattacccttggagaaaaaaaaactgtatatctttttttttttttttttttgagatggagtcttgctctgtcacccaggctggagtgcagtggcacgatcttggctcactgcaacctccgcctcccaggttcaaacgattcttctgcctcagcctcccgagtagctgggactacaggcatgcgccaacacgtccagctaatttttgtatttttagtagagacagggtttcaccatattggccaggctggtctcgaactcctgacctcatgatctgcccacctcagcctcccaaagtgctgggattacaggcgtgagccaacacgcccagcctactgcgtatctttttaaaagttgactagttacttgaaatgtgccccgcacatagaaatgataaatacatgagataatgaatactctaaataccctgacttgatcattaacacattctgtgtatgcaacaaaatatcaaatgcactccataaatatgtacaaatattatactacagtaaaaaacaggctgggtgcggtcgctcatgcctgtaatcccagccctttgggaagccgaggtgggaggattgtttgctgccaggaatttgagagcagcttgggcaacatagtgagaccctgtctctatttaaaaacaaaaaaacaaaaaaacaaaaaataaatttaaaagttaaaaagaataaaagaaaaagtcaattgaaaaaggtaaaactgacaagctctcttttgtgccccattcacaaatgtgaaactttgttctatgtaataaaataagtattactgcacacttgcagtgctgtctcctcaacacaaaagagtaagaattgaacactttgcagtcacttcatgaaggtaagaagggagttgagacactgaggtctttttttcactctttgttttgacatttaaccaaaaatacaaacgaaactcaagtacctttaaactccaatgtaatagaaataaaaatagtatatatcctatataggtaatgaaatatgaatattctaaaaactgtagatatggcatatattggagagttatggtcctttcctctgttacttgggactactttatcataattatgttttgggttttataaagaagacattacaaacattttgactgtttatgtgaggagagaatgatgatctggaagcaaagaaacctatggatggatgatattcactgggaatggaaatctccttgtagattttgtgaatctgtgtctgtattgtttgttcatgtgttaaagaaatacacttcaaacagcatttgcaagttaaagggaaatttcttaggtgcaaacaaaattaaactttaaaggtcctttgaaactaacttttcataatatacaatcttccaatagtgaaaataacttctattcaagctctgtttgttttgcacattgtcacttccatctaaaacaagaccttgctttagcaagtcaaccataatgaacttaattagggacaacctcaggtttacatctgacttggaactgcttcggaagccagtgactaaatgacttaaatatgcttctcattccctttggtctatgccacttggattttcatgtttgattagaatcctgcatttattcctttttttttttttaacagcagaagctaaaagaatcattgccaatgctaaccattaagacaaaatcatattctaggtggatgtgaggcttcatatttttattagaatggagggataagaacgtaaggtagataaaaagcctcagactacatgagtctcctggtaacataccacaggaaacctctttgcaatattaagtacaggaaatgggtgctgaagaattaaggtcacaaagcagaaaaggaatagttacaaactctctctctcctctttctctctctcttcctcccccctcacacacatgcactatttgcttaagtttatgcctttagaaaaagaagtgaaattcactatttttagtttcatttttcttgcggttttaaactaccattatctggtgaagatgaaatgaatgaaatactaccaagaggatcaagatcctgacaactgcagggctgattacatctctctgtttcattactgatgcaaatttttgcggaactgggaaacatgaggcatttttaatggcagtaagtccacttcagtgacagtatgcctcactgaataaatcagaaccaagagaacatcatgaacgacgctcatgaacatcgatgttaatatttctgacagtttaattacatcatattggagctctaggaactcaattgtactgtgttaaaattcaggtacagttcaatgaagtgactggcattcctgttcctgaattatttcaaagatcaaattataaagtataaacctaatgatgtcagccaagtttatttttccagataaactctctgtgagtctttaatatgagtgtccaagtataatacaaatgtaaaattggcttctttgctttaatggaaaacttttaaggcagtgataattgtatccattcagacatttttttgagtgcctattacattctaggtagtataaaaacaagtagagtataatcttgttttcttcttttctccatattttcatgatttctcaagatggttttaatgcattgctttttttctctttttctttttttttgagatggagtcttgctctgtcacccaggctggagtgcagtggtggaatctcggctagctgcaacctctgccttccgggttcaagtgattctcctgcctcagcctcctgagtagctgggactacaggcgcgtgccaccacgcctggctaattttttatattttttagtagagacagggtttcaccgtgttagccagaatagtctcaatctcctgacctcgtgatccacctgcctcggcctcccaaagtgctgggattacaggcgtgagccaccacgcccaggctcatctctttttaagaatcgaaatcagacatcacatatgtgcatgagtagaagtgaatcaactcattgaaaaatgcttaatgcctaatattttctgtgtcagaatatattgtaaaagttaaaacagctaaatgaaacctgaagttaaagtaataccattgtaatatttgatactaacccagatttttaaaatgccttttaaaaaccacaaaagtttaaaaacagtaagattcatttatttattcaaatatttattaaaatccaactatatatgccaggcactgttcaaatggttgaacagtgcctggcatattgttcactgaagatatagcaataagcaaacaaaccccacccacacactctctctgtgaaactcgcattcataaggaggcacacaggcttaacaagtaaataagtaaactatataggtatcttgagtggtgatgaacactctgaggagagggctagcaagggacaatgagagtcatcagaaagtggagtcttggaagtcctcattgatgagatgcagttgagcaaaagctttaagaactggagggtatgagttgcacaagtatttgagggaaaagtgctccagacagaaggattggcaaatgcaaagactctgagaggagagtgtgactggcttcctcaagcacagcaagaagtctaatgtagataaagcagagtgaacaagagctgggaaaacagtacttccctggcctggggattcggatttggccacataacctgctttggaaaatggaatgtaagcgggcatgacaaaagtagaggcttagaatgtctttgactggttggggttgcccgcttgtgtttatgtgcacaagaagcatatggcccaggtagcttgctagcccaagaaggatgagagacatgttgaacagacctgaacccaaaccacaacttggtgtcaagtccagctgattgccagcaaaagttcagccaaacaacagatgcgtgaatgagaaatatgcaacttgagaattttgtggttatttgttatgcagcaacagctgactgatacactattatgggcatgaaacaagccagatataatatttatggcttgtctaatcatacactatgtagctacaacataataggtgtattaatccattttcacactgctatagagatactacctgagactgggtaatttataaaggaaagaggtttaattgactcacagttccagatgcgtgaggaggcctcaggaggcctcatgattataagtttagaatcatggtggaaggcaaaggggaagcaaggcacctcttacatggcagcaggagagagagagagagagagagagagagagagagagagagagagagagagagagagagagagagaagggggaagtgccacacactttaaaaaccatcagctctcctgagaactcactcactatcacgagaacagcatgggggaaaacttcttcatgatccagtcacctcccatcaggtccctcccctgacacgtggggattacaatttgagatgagatttaggtgggaacacagagccaaaccatattaataggcaacctcaaaatatttctgactctaacaataatacctgtcatcacaagcccctcatcaccaaaaacaaaaacaccttttcacttttttcacttattcaacaagaaaatactgagttccagttgcacactagagacctgcacagcccttatccctacttcacagattcattgcctgctcaaatagcatattgctagtctttgggggattttaaacttagttgatggcaatgctttaacacttaaacttgactctactccaaggtgatttccacaaacatgcataaataatagatgtcagtgtggatgtggtgaaaacagaacacttttacactgctggtgggaatgtaaactaggacaaccactatggaaaacactatggaggctccttaaagaactaaaatgtagaactaccatttgatccagcagtcccactactggatatctacccaaaggaaaggaagtcattatgtgaaaaatatacttgcataccaagattatagcagcgcaattcataattgcagaaatacggaactagcttaaatgcccatcaaccaacgagtggataaagaaaatgcagtatgtacgtggtgtttatatacacacacacacacacacacacacacacacacacgccatggaatattagtcatgaaaggaatgaaataatggcattcacagcaacctggatggagttggagaccattactctaagtaaagtaactcaggaatagacaaccaaacattgtactttctcacttataagtgggagctaagctatgcggatgcaaaggcatgagaatgataccatggactctggggacttggggggaagggtgggaggggggtgaaggataaaagactacacgttgggtacagtgtacactgctcaggtgatggatgcacccaaatgtcagaaatcaccaccgaagaacttattcatgtaaccaaacaccacctgggttccctgaaaactactgaaataataaaaagagaaaaataatgttttttggattattagctatttggtcttcctggcttgtctgattgtggtccaaataaatcactgaaacattttttaaaataaggaaagacatagtcaaagttaaatagtaccgtgatatagcaaaatatgatagtctcctttaatcactgctgaagtgaagaaaaaagaagtgggatgactcaatttaatccgagaaaaaagaaaaggaatgctttgccatggcaagatattcttcagtcttctgaaatataacgatggtttcagatccctttcttgaagggaagatatcccatctgactcacttccctttgattcaaacgctgataatggttctatctgcttaaaaagtgattttagccagaacctacgcagcctatgcagaatagacacaagaattactcctgtgtttttgtctgaatctaaacaaattattttctcttttttttaaaaaggagctgtgtacaagaaattattttttctcataaagggggctgtgtatgaacaaatacgcccaccaacatttttctttggattttaaccagtttccgacttgatgtgttattatcttagtacttgtgtatttcctgcctttctccagtattttttagaagaaaaagcacactgatgtatccaatacccaacatttggctacaattaatttttttccatatgatataggaccgatgctttcaatttcacacataaattctgtgtgtaacacctttaacatattatggtgtacaatgttgttgctgattattagctgatcagttgtgaatggtggtgaaagatactgaaactagtagctaaatttcctaaacgtgtgggctgttccatgtgtacacaagaatgtattatgcttgatttctaaaatattaactcaacaagcactttactgattgtttgttgcacagagtatcctcatacagtaacgacaatgagcaagacttacatcctgtccttaaggagcttaagttctagggagttgtaggcagaagaaagaagtactagtaactggctgaaaacatggctgggtgtggtggctcatgcctttaatcccagcactttgggaggctgaggcgggtggattgcttgaggttgggagttcaagaacagcctggccaacatggtgaaaccctgtctctactaaaaatacaagaaaaagtagccaggcatggtggcgagcctgtaatcccagctactcaggagggtgaggcaggagaatcgcttgaacccaggaggtggaggttgcaatgagctgagatcgcaccactgcactccagcctgggcaataaagcgagactccgtctcacacaaaagaaacaacaacaacaacaacaacaacaacaacaacaaaaccagaatgatataatgcatgattaagttccaaaagaaaactcactgagtgaaaagaaaggatgctatatttcaggttaagaacataatgtactcaaggccaaagagcacatttattctgttgtcaaacagaaggcataaaatgcttaaagaggggaataatatgatataatttgaatggtagaagaggaactgaagtttctggaagatagcttagaaagggagagagaccaaaggcagaggaaccaattaggaaagtattcatattgtctgttcaggtaacacatgatgagggctaaatttgggcagaagtagctgaattgaagaattttgctctttttcataagtagcaaaacacactgaccttggtgactggattgatggtggtggaacatagctaaggaaggcaggtaaaggaagaaggggtagaaaatgactttgtatagattgggaaattggaagagatgctccaaaggttgatcatgatttcagattaggctatatttttatttataattttatccagaagatgctcaggtgggaggtctgggctggaaatcttgacttaagagttgtcagcatagcagaagccaaagtatggaaggagcgcccagggagagtgaagaacggtgaaggggatggagaatcttgaggaaaaccttgatgtgatgtactgaggataccttacctatatggtaatctggcataaaacatttaacccgaacccaatcacttggatacaagcagacaaattcaaattgggggacattctacaaaacatctagcccgacctcttctaatatatcaatgtcatgaaagatttaaagaggctgggaaagtgcttcagattaaaggagactacagggacatcactgatcctgaatgtaaaatatcgctatgaagaatattaattggcagaattggaggtatttgaatttaaattctacattatataacagtattgttctttttgagcatgataattgtgcttatgcaagaatatctttcattttagaaggcacgtgttcaagtgtttaggggtgaagtgttatgtatgaaacctaaccattgagtggatcagtgaaaaaaaaatccacaaactatatacacgcatgaatatgattaaatatgcacataaaatataaacatatacagtatataaaaatatgttaacatacagatatacatgttaatctaaatatatgcaatccatttaacaacacatgaatgtaaaagtacataaataaatagctataaagcaaatgtggcaaactgttgaattaattgcagttttgccataagtttgaaattgttctaaataaaaagctagggagccattatgtcataaacctcaaatgtacatgataaattttttaaaaagcaaaggaacagtttaatttttaaatcaataaaatataaaatgcttcaaaaaacagtaatctggtggaaagttaggagtcatcagagataaggagttgtctggacatcacagatttgtatatggagcccatgagagccaataggggataaacattgttaattgctattttgttctgtatttgcttcctccaatagaatgtacgtttcattagcacattgtctcagtaagaactgtacagaatacaaatggtacatagagactcagtgataagtatttcatggcttgaggaaatatgttgactctttagacacatcacctaatatgacttgtctcatgtttcacttaaaagaaaatcagtcatcggggttgcatatttaaagaatgcagctctatccagaatgtggttcagcagatcccagccttgtatctcaaaccttcaaagcccaagtatatacactgcatttatttaaacacctgtgtgcatccttcaagaagacggtaaggcttttttcctttttaaatgaagttagcttatgcagttcgatatggtttggttctgtgtccccatccaaatctcatgttgaattgtaatccccatgtgctgcgggaggggtccggtgggaggtgactggatcatggcggcggtttcccccatgctgttctcatgatagtgagttcgcataagatctgatggtttaaaagtgtggcagttctcccctcgctttctctctcctgccgctatgtagcacatgccttgcttccccttcaccttcccccatgattgtaagtttcctgaggcctccccagccttgtggaactgagtcaataaacctctttcttcataaattacccagtctcaggtagttctttatagcagtgtgaaaacagattaatacacagttcaagaaaaagtacccttgaattcagtcttttctttcagaggacaaatttaacacagcttatccattttatgccagcaagttatctcttagcttagccattggaatatagcacttttgtcctggtattcagttctaccatgatctttttagctccacagatcatcaggaccacatcctaatgtgcactttaatttgagtgctttaacgagtatgctgcctattcgccattgtcaacgacctaaataattattaatgcttctaagcacccagggctctgaatctgaccactaaaatatgtaacttagtttcatatgctttacttacttaaaaaagggggaaaatcctgaagtagaaaaaaataagaggtactaaagctcagttgttttcagaatttacagactttgcaaatgcatacagttgtttttcatgtagtgtgttgtcatttacaatcccaacagtttattagctatattcagatctcaggtggagggagataatctgacacagagattgccttaaatcatggaggtgtagtaaattcaggaaaataacctcaaacatatccttttccttctcaaaaaaatcaaaacctggctttcctacaagatttggcttctccagaggaggatgtgcctcttcccactgctccaggttcttgaacttcatcacatttatttcaactaccctgtctctttcctcagaaatgttcatctcctcagagccctcgtccatcttcttcaacatcttttccatcctgatctaccactgtcgtcaggatctggacctcacccctctgctgataagctcagcaacgttggtctcatcaactccatgaactgtactccctacccctcagtgatctccaagtaaaatcttcagcagctcgctgggaggcaccatgttagatgtagaaattgcttgaaagtattttacttccatgatatccaacttttgaattttcccgactgtgatctccaaatttttcgccataaaactcacccacacccctgacttttcctttctgtcctatccattttggttaaggcactttgcctccctttattctaccctcatggaagagctcaagtatgaaatgaattcctgaacacatcatcatatcaggcaatagagctgtaagtgtatggaatcaaggagtcacaggtcttttctattctgtgaggtaagatttgagaggaccaagtatataaccagtttaggtcccagggaaaagtaaggagagaggatggagctgactcctactgggcctttacagagaaagagaaatgaggaagggggaccaagtatttgtggccttcataaaaccctctattgtctagccagacacagcaggaaaaaccaatgagcagctggctaggaacccctgtcctagccattcattaccactgtaaaatgccctactcttgttttgacctttgatcatttatgcctcatcagctccacctttcttagaacctagtcctaggcagagaacattgctaagaatgagaacagaacatgtggaccatttcctcaacaaattcatccaacttttgcctaaggcttccttcttacttggtaatgtttcaaaattgtcttcactttccttaatcctcattcattttaagattacctagtctttcatttcattgaaacagaagttttccaccttcccttctcttggcctaaaatggtttctcaaaattacccaatgcatttatagtgacccaatggactgtgatttattttaatttccattgagctctctttagcatttcacctttttgtcacatcttccttgaacctccctacttatccatcctttactatcccattacccaaatggaggtcttttccaaggcactggatcgaagcacctgtgttatagattttatagatttctcatctcacacccttcagcaatcaattctatgaaactcattctcaaatctctccagtttgcccacttacttcaagtatagatctgtatcttaatttcttttgggacatgacttagaagacctgtcaatttctcaaacacattatgtccacaatcagaagtttcactatcttcttccaaccaaatcctctcccttcattcctcttcttacaatttgcactcagtccccagaccctgggaactctattttttttttttttttttgagacacagtcttgctctgtcgcccaggctggagtgcaatggtgccatcttggctcactgcaacctccgcctcctgggctcaagcgattctcctgcctcatcctcccgagtagctgggactataggcgcccaccaccatgcctggctaatttttctatttttagtagagacagggtttcaccatattggccgggctggtcttcaactcctaaccttgtgatccgcccacctcaccctcccaaagtgctgggattacaggcgtgagcctccacgcccagccccctggcaagtctatttttatagaatagtctcacagtcctctcctcccacatctctcaagtgcaggccctcagaactcaccaatcttggccttggcaattgcctcctaactggtcttctcacctatacaagttttctgtgggccagatagagctgccagaatacacctttttagaattttctttttagacttttttcgcctggtatatgattttcagtggctccctgataccaagatgagtcaaacacttacggccaaatattcatgtccctgtaatacgactctacctttcttcagacaacaaaatctgagagtagctaggacacttacccatggagtccgaagtttgactgccaaccactcggagcagcataggctgactgctgtcggacctctgtagagaggtagaaggagaggacaccgttgtgccattcactttggcctctgcctggggctaagtcatccaaaagaaaacagaattacttttcataataaacatacaaatgtataaatttcaaaatatgatacacactcaggactcataaattttgacccttcctactttagaagccctcccaaagattgtttaatttgggatatttcactgttgatataatccatagaaactgtctttgtatctgaattgtgctcccttataaatttgagaaaaaaatcagagctacactggaatgagactatacatcattacattaaataactggaagatttagaaggtcatgtgtgaatgatgagactatgtgagatctcaaaactgtaatggaagattcatatctttgtgaagtattaagtaacaagatagagagaacataattgaaaaatttaaaattcccagaaagccagaactatgtccaggtaggtcctcttacaatgcagtatcttgctaggttttcgatggaggcttaaagaactatgtgttagggattaggagaaaaaaaacacaaaggtataccagaaaatataactaattgtaaatgaaatagttccatttcaagaagtgaaatattcacttttagagaactagtggaaacctttaggcgtttttttccccaagatgtatttcaaattggtcaagaaaaaaccattttggtaggaaacaatattggacaaatacaaaaaagacacactagtttttctatctcctctacttctatcctttgatactatcactttgcaggcacataccaagcacttaagaattgatgcttgttgcacctataaaaagtgctctctgaggtttagttttgtttaagagggaaaaatgaatgtttgtaaaaatcccatctctctcctcacttgctccagcagctgccttagcctgtgtaactgtgactccagctgtttattgtggtcttccaggatttgcatcctggcttccaggcggcctttgtgttgacgcagtagcttggcctcagcaatgagctcagcatcccggggactctggggagaggtgggcatcatttcaggaggggacggcagtggggacaggcctttatgttcgtgctgctgctttagacggtcatattctgcttgcagattcctattggcatcaaaaaagtaaaaaagaaaaaaaaagaaagaaaaagaaaaagaagaaaaaaagtaatttgaatatcatcaccaaattttatataccatggtagatagatgcatctgactgccaccgaagaacagcaagcaaaagaggcactaatgaatggttttaatgatgacaatcttaccagtgctaaaagaacaaaacaaaatttgaagcttttgcctggtgtgtgaagggagccatgcttttcaattttttatgttacactaaaagcctcgcgactggtatgttcagataagtaagcagcaaaggatttaatcactttgtaaatatttctttataatgtcatgagattaaaaattttatacctctatcaacactttggtttgctctaaacattagcaaatattttcaacagaaatgtataagaatggagtaagtatacccatgttcctatcacctccccttgataagtttatcatttgccatattttcttcaaaagttttttgaagaaagaaaagttaacagccaaagcagaagctccctcacatgcccgcctcaacaccataccattctctcctccccgctgccctcaaggagataatgccacactgaatttcatgcccagtgttaccatgaatgtatcaacaaatactaggttgagcttaaaaaagatgctgatgtttgcctgtatttttctttcacctacaaaaacacccattttatgtgattcaatctaataacattattttgcatgtttttaaactttaaatttaagaacttcacatttaagaatatacataccattctaagagttgctttttgccttcaacaccattttggagatttctccaggtcgatacataatagtttgctattttaactgccataaggtattattattctgttgcttgaatatgccaacattttcctgtccatggacatttaggttgtttccaacttttcactattataaacaatgatacaatgaaattcttttttatacctatctccttggatacctgttgaagagattctttacagaatatagtttgatgtggaattgttggatcttagcaacatcttcaacattgctacatgtcaccgaatcgctctgggtgacaaatcggtgcttttaccaatttactctcgcttcagtagtgaatgaggttttccatttggcccacctcctcaccaaatacttggtgttatcagacattcaagttttagttaacctgatgggtgcattttaatttgcacatacatcccggattactggcaaggttagacttcttccatgttaactggcttttcatgcttcctttacccattttcctgctggattgtctttttctttttaaacctttggatatgttctagatgctaatccattgttagttatgtgcatggcaaatatgatcttctacccttatcttagtgtagcttatctttaactttgcttatggcatcctatggtataaaagatgtaaattttaacatatccctgtatgttctctgctttttatgttttgttcacgaaaatcttttcttacacctacattttaaagtttaaaatttggtttttcacatttaggacttgaatttacccagaatctatttttgtgcttgccgtgaacatgcgatctaattttacttttcccccatggataaactatgaagccagcctcattcattgtatggtccatctatttcccactgatctctaacgatgcttccgcaaaacatcaagtgtccataaatatacaggtgtgcttctgagctctgtattctagtctgtggttctatctgcatatccctggtagatcccacactccagctttaaatcaattgatgtctgataggccttctcagcccactttgtttttcctcaaaattgtcttgactattctgacccctttgatcttctccatgattttagtgtttggttttctgattttatgaaaatgcttgttgaaattttgagtttgaattacattgaattcataggttaaactgggaagaactaagttcataataattgagtcttcacatccaagaatgcagtgaagctccttacttactatggtctcattttatgtccattaataatgttttacttgttactcttttttttcctcttgctttacaggttgaataagtcattgattttttatttttaatgaacacatttagggttatacatttcctccttggtaccactttaattatataccaaaagtttttatatacatcacctgattcaattcagtgccttatgttttgtaattcttactgtgatttcttttaacttaacccatagtcatttaggagcacagtggttatatttccattttcacttcttagtgcatttctaatttaattgcgtttcaatcagagaacccctgtatgatactgatcctttgaaatttagcaatacttctttttgtgacctagttcacagtcactttctaaaaatgttcattgagtacttgaaataatgtgtatttttccattggaaagatggagtctctaaatacatagtgtgctgattttgttgttaaaattgtccatatctttattaatttttgattatttgtagctatcaatttttgttagatgagtgttgagatataattatggatttgttagtttctccttttaattctatcataattcactttatatatttctagacctatatagttagatgcacagaagatcctcgttgttcttgcactgtttctaggtagtatactttttcttcctaataatgttgattgccataaattttattccatttaaaggtttctatggttattccactgtcttttggttatatttggttaatttccaaataaatataaacagtattagcacatgtgaaggtcccaaatgctttaggatttactgagaatacaattccaattgaggacatttctgatatttgatatccagtgactgattagaactcttgacatctttcttctacttgtgataaataccaaaataagatgacagatttctgttgttcacagatgatatttcatcaggtgagagaaattcctatccacaaatgtgggagatctatatcaatgagaaaagagatgaaatgtaagtagtgagtagccaagaagagttttcccattgtccagtttgagaaagcaagatcatctcatcaccaggtctgctaaatattttctgttgtcccatactcggaatgaacattccacaggggacggcatgtcttccaaaatgctcagtttcaaaaggctagatctccacatggaagcagaaagaaaacccaatctactctggtttttttctttgttttgttttgcttcatttttttcattctacctagtacctaacattacaaggtttccaggaatttatttaaagtcacacagaaaatcaatgtatgatctttttcatctacagaaatagaatctcctatctgtactgattgaaatcctattgctatcagccttcaagggtagttgtttgtatagtttatttcatagcaatctgctttgacaaagcagtgatgagaagagattcatcgaagtaagtacaccttcagtcagattctgcacacgggtcttctgggtgtgcaccgatgtatgtaactgtccacattaattaaatctaatttctgagaacttaactggcaatcagttcaatgtttctgtgaacttgaagcagtatccaatgttcacaaggtctcattccataggaattactttctatttttccctcttcattaaaagaaaacttcaacaaaatgttctaactggcaacactttttatgtagaatcctattcaaatttttctttctaccagattggggcagccatggtgttccttttgaaaacagtttttagacatggacctcaagatggtacaacaagccattactgtcttcccacctatttttcacaaaggtgctgacaggagactgccttttctagagagatcttccttggtatcttgatcctgtgggtttagttgtccacagggctcttcttttatgatttatttataaggacccttgttcaagaggcatggtttggtatatacaacacattacatttctgttttggtggtttccagtgaaaacagaaaaggctcattttaatcagccaaagctgagctgtaaagaatatcaattgctcaatgcaggcctttctttccttcccagatgtttgaaatttctcttgggagcacatttccttcaagactcacatccttcttcaattctggaagattctcagctatgacagcttcaaatattacttctctaccatttcctccattttcttctgaaacctctcaaatacactcctaaacaaacctctaaattctagtaaggtatattgtagagcctgtggtcaattctccatttctcctaattgctcatttatatttcttatctttttctgtgagtgttgtacacagtaacattctcagcatcatcttctaattcccttgccttctctgacaggacaaagtctagaatttatcctgtatattgagtttagtaacttcaatgactagtttttttggcaaagatatctttgttttcagacctagttacatttcatccatctctgtttcttagtttcttgttattttagcgagtggtaccccttatttatgcctttaagcatctttttttttttttttgagatggaggctggggtgcagtggcacgatctccgctcactgcaaccaccacctcctgggttcaagcgactctcctgcctcagcctcctgagtagctgggattacaggtgcctgccaccatgcccagctaatttttgtatttttagtagaggcagggtttcaccatgttgggcaggctgttcttgaactcctgacctcaggtgatccacccatctcagcctcccagagtgctgggattacaggcgtgagccactgcacctggtctgagcatcttaaatgtaagtaaaaatctttgttgtactagtgtattattttgctttcttctagaattaattcatctttttttttttttgagatagggtctcactctgttgcccaggatggagtgcagtggcacaattatggctcaatgcagcctcatcctcctgggctcaagcgatcctcctatctcagcctcctgagtagttgggactacaggcatgtaccaccactcctggctaatatattttaaattattttttgtaaagatggcacctcactacattgccctggctagtctcaaacacctgggcacaagcagtcctcccaccttggcctcccaaagtgataggattacaggtgtgagccactgttcccagcctaattcactttttgatgtttaacttgggtggggggtgctatcccatttcttcatgtattttggatcgtgatttggagacaaattttgcaagggatgttttgcatgtgcatacatatgcatgtgtatgttttctattattctcatgtgtgtgtactttaatattttcctctctttttaaactcattatctctctctcaggtggttttatggcttctcccagccatacccaggggcttagagtttagagccacatctgttggtagtttgcagctcctacactgagtgatacagagatatcactcatttcattgccaggcagtaggtagattggttcaggtcctggtttcaaggctgtgatgctctctttcccaactgcgaatctttgcctcttccctcggctctatgcattagggccatagctgcatataagctgtagacccttgcagcaaactgtttcttttcatgttgcttttaagtgtaagtgtgtatgtgtctctctctaggtgtgtttttgtggggctctgatttcaaatagtaatcctggctttgggccactaccttgtaaggagaattttaatccctgttactacagcacgagctgaaagcccactaatttagccccacttacttttttttttttctttcacatttctggttcacagagatgttcatcttgctttaaagcccagctatgtctttttcatttttcactccatatattatctaccactggataaatggtaggagcagagaaagatgccttcaagcaagagctaatgttatcttaatcagaagcctaccaggacacattgattttgtagatgtatagtcaaggttccctcagtattaattcaagccttaattcatcaggccaggattaaatgagtcgaacaagtgcttttcttctaaacaaacatatgacatacagaaacctcttattaagctcaatagcaaacttgattttgagggactagtttttcctcctgaagctctgagataggacaagctgtcatgataaggattctaaaagccagaaatggttaaaagaggtatcttggcctgcaaccaaatgaaataaggttttttgatttgagtctgaattctcttttaaggtatttctaaatgttcatgagaattatcaagaagaactgatgctggagggtttgaactagagatgatttttactaaatgttttctaataaatgcagtcatagtcacagagctgtgttagggcatatttttgttaggggttgggaaattgagccatttagcccttatcaattacgcatttgaattttcttatatttaaaaacatctatgccaatactttttgaggtataccataatgttagttttgatgcagtattaacgtaggggagatcattctcataaatgatcaaggttccctcagagttactgttccaaggtaagttattctaatgttttttttttatttttttattttttattttttgagacggaatctcgctctgtcgcccatgctggagtgcagtggtgcgatctcagctcactgcaagctctgcctcctgggttcacattctcctgcctcagcctccagagtcactgggactacaggtgcccgccaccacgcccggctttttttttttgtatttttagtagagacagggtttcaccgtgttagccaggatggtctccatctcctgacctcgtgatccgcctgcctcggcctcccaaagtgctgggattacaggtgtgagccaacatgcccagcctctaatgtttaacaagtacacaatgcactcgttttaacagctgtcaattattaccaatacatattttgcttttcttgaaggtatacacgtacatctcacccctaatgattctctaattgttagaatgtagtcatgaagtcatttcaatacagatgaatatatgtcagtgatcagacaacgactccacagagaatctatttacgttcttgattatcttgtaaattatatttctctggtagctccctaaggaacattaattcaaattcaatacacatggcttctgtcactacaatttcttcctgtagccagtcatcctaaaaaaagtcttccatccagtatttcttattctctatagagctaagaatccccccattctacaaatatgtagatatatctgattaattttatgtcataaagaatataaactctgttgtctacatacaaatttacactcaaaaaaacttcccaaccaactaatggacataagagattaatcaaattggcaaggcttgttcccttaactcaacctgctgaaaacatgaaagcagctggcccttttagcaatgatttatgagtgcctctctagcaatcgtaactattatgtatgataaagaacattacaacaatctctgtgtaatttaaactaatttacaaaggtcaaatgatttcagtgtaagtcatctactctttaaatggagcttccctactacgtgtagttatatagttgtataatgatatttatgaaataaagaaatgaaggtcactttccagtgatcaatgttttcttaacagtatcatacatttaactgtataccaaagcatgagcacacacagggattattttgtaaagtagaacaactacaaagattgccatctaaaaggaatagatccaaagaaatctggctttaccctcatataatattaaaagcagctaaatcatatccaccaatctaaattcaggcaaatgtagtaaatcatacagaactattacagcagctataaatgtagccaatcagcagtttttttttaaatgaaagacaaattctgcaagcaagatgaactttaaaaactggaaattgcattgagcccttgaaattacaataaagctcagtgcaatggctcacacctgtaatcccagcactttgggaggttgaggtgggaggatcacttgagctcaggagttcaagaccagcctgggcaacatagggagacacccccaccatctttacaaaaaaattgaaaaaaattagccatatgtcgtgacacatgcctgtagtctcagctactcaggaggaggaggctggggtgggaggaccgcttgagtctgggaggttgaggctgcagtgagccatgatcatgccactgcactccaagctgggtaacagagggagactccatttaaaaaaaaaagtgacaataaaattttacagtacagctttagacatctttatcaaacacaaattcaaaaatacccctaaactaggtggaaaaagacattaataaggataagctcacagggtgagaagtaagactatgcatattttaggtcagccttaagcaaaacagtaaaaatggcaggacccctccaggctcttgtttctaatcatttcttagcactgtccccctttaaaacattcagagccttacttccaagccctttcctactgaaatttgctcagtataaaggttttatataagacatttacattttactgggattttataataaagttgtcatttcttctagtgatatctgcattttaaaacagatgtcaaagaacgtaaaggaaaaaaataaaagctttgccccatcaggggaaaggttgaacaatgccactttttgacacgctgcctttgtggtgcctttcaccatccatggctgaggagagaattagaacaaggcttgagagatggtcttggattcagaagatcttgatttatgacttacttgcctctgctgcttgctgaggctgggcaactgacttaagcactaattcagttatgaggattattaagccagtatggtcgacattctatatgtcaaactttctttgaaccatgcccagcccatactgtgttcaataaatgttggttactattattattgttattacttctttctctatatattatttactttttggatttagaacctcagatgtgctaaaaacttcctataaaaagaaagcacttaattatctgaaatggaagcaatctacttagacctactgagcttggcagaacatatgcatatctagcgcttagaaagtgactaatcactcagtatttgtcctgtagatacctgagttctagcccctagccacattgtagccacccccaaattttggaattattgtgtatcatccatcatctgtgccttagtaaagtttatcacagctgaacatctgggcaaaatgaaatcactgagttaagatcactaggatgagatttccttgatttgacccaatacgctaggtatgtgatgaaactgtcaaattataatatgtccatggatcattgctgaaataaaatatgtggaccaagggtacagggttaatgtatctaggtggagtctattttctggatatgtcattgacacgtagatctgtatcttgctcaagttccaagagacagaacatgacaatattaattggcttcagtttcttaatctttaatgactgagatgtttttcacaaattcctgatcagatgctaattcattactgtctatagactaaatgtattaatcaaaagttcaacacaagaagaattcataagaaattttaaccacttataactggaaataagacagactaacaaaacctaagacaaaaatggcagtggctggtcatcatcagccaaaaggaaaaactaggattggagaggttttagaggtgaagaactctagtcctcaggaatactgccattgggaaaagtgtgtttccattttcagacaaatacagcaaaatatcaaactttcattgtctgtggtcagcaaaaagccgtaacagtctctagaagaatcataattttaagctttgtgtgtcccggcttcaatccctcatgcgtagttagacttagtcttaagttctcccagtaacttcaatttgatggcctatttttcactccctggcatgcactgctatatactcttgccatatatgatcctatggcctcctctattacaatgacagaaactatagaatcttttttttttttttctttttttgagacagggccttgctctgtcacccaggctggagtgcagtggtgtaatcatagctcactgtaaccttgaattcctgggctcaagtgatcctccagccccagcctcttgagtagttgggactacaggcatgagccaccatgcctggctaattaaaaaaaaaaattgtagagacggtatctccccatgttgcccaggctggtctcaaattcttggtctcaagtgatcctcccacctcagcctgccaaagtgttgggtttacaggtgtgagccaccatgcccagcccagaataacttctttaaaataattaccggtacttgtacatgaatgttcatagctgcattatccataacagacaataagtagaaatagcccaaatgtccatcaagtaatgaatagattaaaaaatgtggtatatccatacaatgaaatgttactcagcattaaagaaagaatgaaatactaatacgggctataatatagataccattttaaaagattacgctatgtgaaagaagccagtcacaaaagactttatattgtattatttcatttacattaacagtccagaataagcaaatccatagagacagaaagtagatcagggattgtctactgctagggctgaaaagagtagttgcaggagaaacgaggagtgacttgaaaatggggatgggatttcttttggggggtgataaaaatgttctaaaattgtgcgctgatggttgcacaactctgtaattaataaccagtgattactaatactggttaacctattaactaataatcagtgactaatacactgtaaatgggtaactcctatggtacgagaattatatctcaataaaggtcttataaaaaactaagttctagattcaaaattttatttcttatagcacaaaagatattaccccagtgaaaacaataaaatcttataatgctttctcctactatggaaaaatcaaggtttaacccatgtacataaaagaaaaatggtatgcacatgtcttcagaattatccgtgtggacattaaatattttcagatgatgagttttaaaaagagtccaaaaataagcccagaaaatgcttaagtctgggttagcctaaacaacttggatggtttcagtctaatggaaaatgacatcacaaactaaacaggtatattaagggattttgggaaagaaaataatgtaagaaatgagaaaaacaagggagatacctgaaaatcaaccccaaaaacccatcaagtaacagaaaaactccaaaggatatttacccattcatttttatgacacatttatgtacccagtgctgtggagataaagatatatgtaggacactgtcccttacccttgaagagctcacattctagagtgtgggatattgtttacttccaccatggaaacaaaccttactcgaaggcaaaaagactgggaatcatgctcactgctaaagctaaaaatacagatttttatctttgaaattatcgccttgatttaccaggaaattacaggaaaagaatcatatggatttacttatgacttgtagttacaacagacagactagcaccataaggtaactcagaatttggagacacaagaaaaggtcatattttaactattaagatagtaaaaaaataaaatgggtgagtttagccatctgcagaagccatccatgtacatatgtaataccaacaggaaaccatttctaactgggctgctcatgcccaattacaatcaagtacatcaggaggtccttggtcttcttcttacacaaactctcttcctaggaggtctctgtcctctccccaggcttccatctccgccacaaccatgaccccttcccgcaactcattactccttaatcaagacttctcttctaaggcttcagacctatctctccaacattctcctggatggctccattagccatgggctctagaagctgaaacttgctaagcaccaagccacacgaggttgatatactgattatgcaagctctaaaatttcagtgccaggaaaggaacagccttcctcaagtagcattacacaggaccatatagtagctacacatctttgtaacttataccttaatcttactttgagatgaaagctatacctgcatttctgtcataagataaagagggagaaatatcttcccatgtgttgatgatacactttaaaatcacaatccaggagaggcctcaagcaacaactggcctttgcatctaactacttacaaagaaagattccacagtaattgtgatgaagctaaaggtgctgtctttggtaaacatctttcaaagttcaatcatttcacaagaaagaactcccgatagcaagttaattgcatcaagtcactggtggcaatttttcttggtggtttgggtgaaaagccaagttattcggtgggatattctacaaaaatggtgcaaagaattttctatgatcatgagagttaatttaatacctatctttagatttttcagactaaatcattctggcttctgggtctacagggtaactgcttcaccactagagcatatgaaaagttacttttgtgcgaaaaatccaggcttcctacgtgggcacctgttatagctttatcttctgatgttcccagagacacaacggataggcttctcaacaactacagtagagagtcaactatgctatctcctagactggttttcaaagtttacttcagacttgaatttctttaccaaagtgtgttccatataacattgcagttgggctcgaggtcaagtaagtgggagcaacatgaggttagacaaagctaatcaggtttcttcacttccaaactcctcagtgcaaatgctaacgtaatgatgactttccagtatgagtgctttcaaagttttactgtccttggaatcctttttttctcagagtatctcagtggtattctgcagaatacattttaggcaacagtgacctttatccttggagaactgtcaccctatctttggtgttttaatgttaagctttccacaattatcaaaggccatgagaaacagccacatataatttcccttgggatttgttataaaaatgttgataaggacactagccaataatcacttcaagtgtaacgctgcttaagagttcaggaccaccacccaagtttgaatacaggtcctattacttgctggccatatgaagtgtccttaatactctgtgccacgtaatcctctggaaacagcctctctttcatagggttgttttaaggattaaataggagttcatatgtactcagaacagttcctgtccatagcaatcactcaaaggacagctatttttgttattattattattacgtagagccaggaaaacaatgatgtttctttaggatgctgcgtgcttctttaattcaatattaagagacagacaaatctttgtttcctattatctccctggctacagggaagctcaaactgaatctgaagcttagtcaaatcaactatgctaatccctatgatgttcattgatctattatttatattgcaggaattgtattgctatgactttttaaagaatcctttctgaaaactgaatacgtaaaatcaacataggaaatttccacttgaaatgtccttgggcaaatagaattcagtatgtctgatacgtagctctttctctccatgcactaaccctttgcaaatcaggagtttttcctgggtgcactaggttgcttttgtttgtttttcaatgatcatttcccagttcccaaattaaaactttccgtaacaccagatgcctccccctctccattttcccttggtctcattcattcagtgaccttctaatttctccatccccttcttcacttgcctaagacatccttagttaagaacctggcatcttttaatggactattccactgtgcttctaccaatcttcatggctttagctttctgccaggtcagttatttttctcaatcctcccccccgtcaaaaagccatcactgttcacctgcttataggataaaacccaaactccttagtatgatgcacaaagtcctttaaacagtagtccccacctaccatcccactgccctcttattctcctcattccaagccacacattactcactggtccaccagtctggaaaactcatccttcccccatctctcagactggaaaactcccattcagtcttcaactcttaaactctctttgtaaaggcctctctactccctctgatagaataaatcattcacctctgtgcccccagagcacttgtaacagtaggatataagtagttgtttctattttaacttttttaaaataaattttgagctccatgagggtaagaaccaaggcttattcatctttgtagtctcataattttaaaattacattaagcactcagtaactatctgcagaattgaacagaattacatcctcaggcctggaaagtagctaaagaaactcatgaccataatcaattctactgtagagggacaattggcaaatgaaggccaacaggaggatgagggtcttcatgaaaaatctaaaaaaaaaaaaaaaaaaaaaagggaaattggattgtaagaacataaactcttatccagcatgttctagggagatggcagctgtacttgtaagatgtgaatattctaatcgccagaggggtgcttcaatttttttgtagtatgaagcagtcctcacaaacatccaattttagatgccaagattctaggctcaccagaacacaatttgatttttattgtgattcctaagacactggattctaagacacaggatgctgtgtgccgaaaaaatgaatatattcctcattttaatagatctagtatttgcacttaaaccagatgctgtctcctcctaaaaaagctttaaggcaaccttgataacattttaatacaaggcagttaaaaagagagataattaggataaagggagaaataaactttcattctgggttatccattcactgccatgaactgcatactatgaatcagtcccctcagacttcaattaactttggataaactgaaggaaatttagttacactggccctgctagttagaaactgagtctgtgaataatggtgattccacttctaccatgttcctgtcctccctgcctgagtagagctgagatggttgaccccattcttacacagcttcttaaatgtggcatgtatgcccttcagctcttattcatccttgccataaaaggtcttggctttctgatttctgtgatcaaactagctccctttgtctcaagaagggctctgtagccctttgttttggggcccatgtcaccaaatgatatagtttggctggatctccacccaaatctgatcttgaattatagctctcataatccgcacatatcatgggaggaacccagtgggaggtaactgaatcatgggggtggggttttcccatgctgtttttgtgatagtaactctcatgagatctgatggttttaaaaagggcagttctcctgcacatgctctcttgcctgccaccgtgtaagacatgcctttcctcctccttcaccttctgccatgattgtgaggccttcccagccacacggaactgtgagtccattaaacctctttttctttgtaaattgccccgtatgaaaatggactaatacaccaagtaacttgaatgcctagtttcgttaaatgtatcatataccacgctttcctctccactccaactttaaaaacatgtgggaacagccgtaggaatcagtcttgaattatttccagtgatgtctactggacattttaacattcattccattatgcttctttcctcccttccttaccctaaattccttacctaccactttgtcttcagaggcagtccttcctctcattcaaggtcacgcctcctcccatactttagttccctaacccttctctctcctgcctcctgtgggaaaatgctcccatcattcccaagctctgccctcctcttcttctggcacatttctccagcatgtgaaaattagagatttttaagtaaaaagagaaaaccagagtgaacactgcacgacactgtgtgaagtaaccccaacaaccataaatatgtttgcaaatatttgcatatgtagagagcatgtttggaaggaaacacaagaaaccaagaaagatggcagcctccagagctggaaacaccacagccaggggagaaggttggagaaggattcacttttctctatatgtctttttgaaccctttggattttgtataataatatacatgtattctctactaaaaataaaagtaattaaatacacactttaatgttcacatcttccggagttctaccaaatccagtgttctccttctgctacatgctcccgggatatataaattcattctcacggtttcaactaccacctgtgagctggcgactcacagtcctaatatctcaggcttatatcctttctacaagcatcagagttctatctctcagactgtcagacatttacacatggagatgtcaccaggacctcaactcgacctcttccatacctcatttatcaccttccagctactcagcccttcaggaaggacctctaataaacactgctgcattaaaggatggacctgctgcaactcctcctgaattatcagtcccagctgcaaataactactatcatcttgttttgtagttaccagccctgggaatcattccttcataccctagtcccacagaactaccgaatcaaacagctctatcctcccccgaaatatcactcagatcagcctgtctacttcatttctatcaccttacttaaggctctaatcatctctttcctgggctcccatgtgactccccccagcttgatttcctcgttccagcatcgctcttttcaaagttaccctccgcacagctgcctgtgtggcgtatattcatgtcaatatcatggcctgactcctggatcacacccttgagttgctccctagactaggcacggaggcagcaactctgcagtgggtaccacacccttcccgacctgcccttgctgacctggtcagcctcatctcctctcattctttgccttcttaaaaaaggtaatacaactgcagtttccctcaaacaaactctgccattcctcaccctgacacctttgtttatattccataggaatgcccattcctaacctcttcagattcccttcattttggccatcttttcaccatcattggagacttgcacaaagacctaatgaaagaacattgaataaagatttcccgtagctatgaagattgatagctactagactaggtccaaagtcatcaagtcaattacaaagtaaagcaacgggatcatgatttccagctactttaattcagtggtatcagtaactgatctagaacttctttgactgtaacaataataatcttgcacaatcactggaggaatttaaaggaaaaagagaaaactcaaattttggcttcataaggtcttactgcccaacaagacatatgaaaggtcctgagtaggtattaagaatctacagagttccctcgtgttatataacatctactaacaactttaactttagactttatggtgaattaggttaatatttagccaccttgttgacttgagaacaatctaatcaatttgctctgcaggtagtagaacgacaatgtctttgtctctcagaaaggctaccttttcattgctaggatcataccttgaatttcagagcaagtcttggtttatttagacagtgcagagacaaatacatctctgtatttgaacactacaggcttaagtcaggagactgaaggctttaatcaacgcaagaaaaaaaagtaaaccttgagtctgcaatgctaaggacacacaatggggcaaaaacccaagatccagtggctctttgccaaataaagatgtatctgaattatatgtggtaatgagggagaaatatgatgcagaagcgaaatattaaagattagatatctcactaacaccattagtcatccaaacttatgggaggcactatgggaaaaactcagtcagatttagcttttactcagagctttagccttatctctgtggcatcaaccaagaatcagagaacaccaatgtgggatacatacagtgcctgtgatttggaaaacgggttcttaacattctaaatttatgacaaagccatgcctggtgctaatcaaggcagtttgaaaaaggggagaattttgaaaagcaagcagaaaacaaagtctttgaaaggcttttctctacgaaattaggtttgtaaaagaactttagtcaaaagtgcatgcatgtatgctacaattaaaataaattcagcttcaattcatttattcattaatgcattcaacaaatatttattgaatactatgtgcaacaaccaggagaaatggaattctaaaggcagagataagatacctctgagacacttctcaaacagccatcctctgtttttctagggggttgtagggaggtgtcatgaataagaacaattaatggaatttaataaatatctagtcaggaatggggctctccaggcctctctcttttgctgttatttggagataaatcacagctaaaggaacataaaatatatatattaacagatcaataagtacacatccaaaggacttggggcaatctcaattttaaatatactttcttattttctctaaaagtatgctcgtatttgtcagattgcgtagcccaatgctgacttaggacatagccagctagacatgcacagagagggcatctaaagaattcctgggttttctcaacaggaaatggcaaattaaaggctccttaagcaacactgaattcaagggtagcgaaggcaaatctagggctctgaagctccttgcgcagaactgcaagaagacaggacagggcagatcaaagaaaacacacgggctgttttcaggaagggaactctgtggagacatttctttggaatttggtagaaggtcaaataggacaaaatgaagggacaatgaaggaagctcatcctgatcatttcgtgaaggtcaaggtaacttacacaaagatttgcatcaaccccagagtcctcattttggagctctaagtaggcctggtgttatgttttttgttcttttagagaacaaaccatcccattcttggagaatggtcttggatatcttccagggtaaagcggttatcgctgtgccacaagtagatgaacaggtttattccgggacactcagtcctcatagatagtccctcaagttaaggcacattctggggaatatgccgcaattctatgtaaatgacattcacagagacttactcttctttattatctggttgaaggcagagttgcctatttagagtcagaaaaatctggatttcaattcagttctaccactggctgactgggaaatctggggcaagctgtgtgaacctctaagaacctgtgtctcattcacagaaaggcgacagtctcttctccatagcgtttgtaagaagattaaatgatctaaaatatgtaaaagtgcactcaaaatgataaaatgataaataaatgatagttatcagtactctttacaaacattctttgacccgggtgcaatggtacggagaaagactatgctaaccacaaacgaggcagggctcttgaccaatgagctcaaaagatatattacacgatcatatacttcaaaaatatatttactccttggtaacatcaaattctatttacagtgtcagttccaactttttattccgatttgactttgacccctacaataattacagatttaacataaatggatattactgattattctcaataaagtagaaatgttttctctaccatggtcttcactgacaaatgatctcaaaagtacggccaaaaataaagctatcattaaaacaacaaaaaaagttcaatattatctcgtggatggtactcatgtgatgttcttgctgtattttcaggtttttagcaaacatttcctgagtagccattaaatattcaaaccatgctaagtactctggaggatatgaagatgattaagatacagtccatgccccaaagacacacactagctcattaaagagaggcactggtaataactgataaaaaggaaaactgtcaaggaattttctgagaaaggtccaaagtgctctgggaatagaggcaaaagacagatttcttccaactgcagggatctagcagggctccatggggaaagttattttgagcagtgtgatggaggataggtgggattcctttgtcagatacggcagtggtgggttagaggttagcagttaggctgagactcaagcttgagcttgaccccaaaggtagatgagagcaggatgtattcagaaatactagctacaacagcatagccagaacacagggagaacaaaagaagatggcatagaaaaagcaagtcaagagaatattgtggaagggtttgaacgccccactaagaagcttgatttttttctacatgcagaaatccagtgaaaggggaatgccatgatgggtcttggttctggcaagatgtacaagtagagtcagtatggaggatttattgcaagggtgggaaagagactaaagggaagccaaccagataaggagctatggccataggtaaaaggtgttaagagctagaaggctcgcagtggcagcaggaagcaatggaagagtggcagtttgttttttcatcctgaagtggcatactcccgagggcactgatctcagacacactgcgttgcctacgttaagagcttttggtgccttgggctcaaccaaagagatgaaagtacttaagacccacaaatctgagcaacatctactttaaatccttgcttggtggcatctgtctgaagaaggcacattgtgagttagaagtgatcatgtgagaagactttttaaaccaagggacctgtgacataataaatgtaatacagaactgaaagtccaatgatttgcattatcctgacacaatacagtaccccagatgtttacatctttgtcctccctgcagtcattatgagagttctttagcctttttctcttctacaatttctgctatttttacatgactgtcttttacaggtgatggctgacaattggaattgtctcactaacctgctatgatggtgagcataaataataatttctgcatttgatgatgaaaaataagatgaaacaattggtttcccaatatgaccaagccaataaccctactttcttaaatgtttgaggtagataatatggccaaacacatgtaaaaaaaatcatataatcataaaattaaataacctacttttttcttaaattctattctgaaatataaaatcaaagccttggagacacatgcaacaagtcaaataccaccatcagcattaactccttcacacctaaaatatgagttcttcatcatactattgcatccattgtcttctttcagataacaaaaaaaaaaaagagagagagaatctgcaaatggagctaaacagattattttagaaaacaattagacataaaatgactctaagtgaagattcctggcacttttctatgtgtgcaagtgtatgcactctgcataccaatgacaaagctagaaagaaaactcacctgttttcttcctcaagatctgctaggattctctctagctcccctctttcctcactctctaaggaaatcaagatctgggcaggactacgaggctggctcaggggggagtcctggttcaaactttggcagtaatgctggattaacaaatgttcatcatctctggaaaataaaatcaaaggttttggttttttcccccccttattttgctttgggggttagggactcaggagtgtatttgaaaatagaaacatttatttgctcttaacaattaattagaccttttttcctgcttctaaagaccttttgatactgctgaggttgtgatctaccattctactggtaccaattcaaagtgttttcttgctcagattttcaaatgaaattgattggcctatttacacggataaatgaaaggcagaattacagaaatactgggactctacgttgatgttagtcaatagctaaaaaatattaaaagatataataatggctgtataatgctttggccaccaagcctgtcaagataatctgttcactaacccacgctattgttgtactgagtaggaaaaaataccttgcagctctaaaagtaacagaggaaatattttattaagtggaaggcaatgtaaccaaaaagtattgcttcagtaagtcagttttaacttatataagtcattgaggcagaatgacaacaacaattaaactggagatacatgattgtttcattcagttattgtttagacagaagaacgaaaattaaggggaaaaaagacattaaggtgactgattaaaagaagactgaacatctcattcctcggggcagagtttttttaaatacaagttttatttatttttaaatttatacataatggttttaaggactaatcttgcgggaaaaggaggcaaaaaggcttctatttggggaggcagctacaatctttcctggaaactaggaactctctaatacacaggacaaacttttttctgaatgcattgctccaagctccggaaaggcctgtttacctccaagttataagaattttcttctgtccgtaatgacaggctaaagctcattgtttctggttagatatcattaagatgatacgctaatattctcctctccatacccacttaagttgaaaaatatcagaaatttaggaaaaagtccttctcatttgaattatttttgtttatcaagccagttacctggtttagatgtgaaaagctgactaaaaataattattgggtattaaaaacacacatttaagtgaagtcaaccaatccaccaaaccacttccccaaacctgcccctaaaatgccatgagtttttgccatccaacattgagtcaaaatggattttatgtcctcagaataagctaaagcttattttaaaataaaacaaaagcagttttaccacctaatttatcacactcattccaaattctgaagttgtactgctagaacttcccatgtttaattataacctagagttgtaactacacttttcttcctgttctcttaggcagtcaatgaatgacagccactgttacgtagatacaactcgaattaatctgaatgtgctagagcttctaataccaaaatcagtgagccaaagaagcacaagctatttacatttggctgattctttggccacacattttactgttgaagtatcttatatattagtaccattaatactttttcccatagctaagaaagataaggcatcacagttatggttggggaaaggcttttttgtttgtttgtttgaaggaagtaagtcatatacaaatgactgagggttgacttgattctttattattagcttgatcgtttatgtaccagatgagattatttattctcatgtcttcaataactagttatatatatgccactttgatactatttcttttggcctaatccttatgaaggttcttttctcatctgagcatgactttgtgttgccacaccaactacatatgataaatttaccattcttccctttgtctatattctccaagatgggtgagatatccttactttatcaaactaaaaaggcatcgtaatactttgactagatttcttctctttatgttatttattcacttggcaaatccttattttttccttcatatttgcttcaatgtctgctctctctacctcaagccccggtcagcatttacttggttcatggcaatgttcctttgtgctctgtattgtgaacactgccctcactctataatgaagcctgtttccctgccatagctgtgttccctgctgctcttagcaccgctctatctccgtccttaaagtttaacagggttggcttatcatcctgctaacaacctgcaacctgaattggtacttctcctctggaaactcttcataagattgcctcactttatttatcttgtgaagatgctaaatcacaaaaatctacttctttggatttctgaaggaaaatgcccaactaacctaccatatgtgaatagccatgctataccaagatcacgtttccactccccatgagtggagaaaatagtacttagccatgactttaaaattaatatcctatccctttaaatatctggcaggtttggtcaaagattaagcattactataaatacttgggactctgcaatttgtaatcatatggtatgaaataagttcaaataagagtaaggcaaactatttttgctactctgaatactaataatgccagaatttggatgagctcattccatgccagggcattaagaattaaaggaaaaaagtaaatgaatggctccttaaaagatcaaatgaatatgatgctaattcctatatcctgtgctatcctacctctaaatccctcaaagcaatttcattgtcaggaacattttgtaaaaagagatgggatacttacatgctctcattaggagagatgctatcatttagataagatccattgctgttttccatttctgctagcctgataaaaaacgtaaaagctcattaaaacttatgtgacgtcttagaatctattcaagacctaatcgaacattcctgaaaactaaaggataaatcatggcaagaagagaaaggaatccttcaaattaaaggatgtgtgtgttggcttaaccatttgaggcagtgtgtggtagaccacagctagttagtagcactacatttatgatagaaattctaaggaaagttatatttcactgttttccccctacagatcagtcttgctttcactgagaacaggtctttgttttcagaagaaaagcttccctaacaataagtgcactccctaccttacactaccccttgtcttttaggacaattactactttccactgatgacagacttacacagctagctaatgcttttcacgattggtaaacatgtccagcagttagaatattgacaaaggatggatgcacagtaagctctctaaacattctgccaccaatttttacctttaaaatcttcttcacctcaggcaattatacagggggttttttgtttgtttgtttgtttgtttttttacaactaaaaaagttaaccaaactcttacggatttaacaagcataaaatattttaaaattagtaattcagtttttaggtataaaaatcatctcaaacacaaagaaggtgagacagaaaagtccaaggattaggaaaattaattattctcttctttacagcatatcatgtaaaataaatacacaaacggaaagctgatgctttcatattctccatataatatagtatcattttttcatatatgaatgtctggtctagcagttttctaaggaggttaaactatttgtaagccaatttagtaaatgtgctcagtataaaaaaacatagcaaggctaccggaaatgtttaaaagccagggttagggaagattattctggactaatgctcttgttggtgaccaaaaacaacatgcagtggaacggcatgcacgttagagggcaagttgattagtaggaatcagacaagtttggggaaaaaaagaaaagatttgtttaaaatatcataggttagctttccttggttagttatttcaatcaatatttgcctggcatacaactagtctcatacctgctagcataatgttcaatgcgtgaatgagtatcatcgtgtgaaagctgaggggacgaggcaggcctataaggcagaaaatgtgattagtcacagataccatccattaatggagaaaaaacccaccacacagttatgttatacacatggcctagaatgcttttattctaattctatggataatgtatacatttagttgctcctatatcttaaatattatcaagtattttaaaatccaggattgagagatgatttctcatacttctgcttttattaaaagccatgaagagaggccaaaatcttctctggaaaattcccatcgtagaaaaggttgggggagacagtttctaggaagcattttgtcctcctactttgtaatttctcacatcctataattccgaaattgtgttagccctatgtggtttaaaattttaaatagtttacacctgcgccatttataggctatcttcttattggatcaaagctgtatatctgcctagatacttacaattattttagcttcaaagaggctactctagtacaagacttcttaaaactccatgtatcaagatgtcttgatctatgcaattttgtaaagaagaaatgtatcttccaattcagcagcaagactataccactaatttctagcacaaaatagaatgaccctggattatattgtgaggttttaaaaaagaatgactaaatttcatagaacgtcatgatatctgaaatatttcttagagatactgtgtgctaaaacataggtgagaaaataagaggagatcattagcaggaatagtctatatgctttttgtatataaacacctatcttttcttatctccataggctagaattctggtagggttaacattttttcatcctttcatatctgatctattaattatccttgaagtttttatagtatcttttggattaaccttaggaaaaaaaaccatctgttctgaaaaccagtttaggcttggactttttcttttaattggaatagcacaaaaggtctcttccatttctctgctgacacagaaagcccttaggtaaaggcataaatccaaaagtcaacgataatgtaattcagagaggaccctggtttagcccagtgtccaagtagcgttgaaggacttggttgaaacactaaggagaatgtgtttgtttcttcttacattaaaaaagaaaaagatgcagttaccagtagctaagcttgcattagaaaatgtgccagaaattcatatttcttaatatactacagtaagataattacgacacactatagcaaataactagggaaatggaattcttccctgagagagaaaggtcttatttatgaaaccaatgtcatctaggtcaagtgtaatcataatcaaattgaaatgagttataaagacgtttaaattgtcaagaggaaacaaaacgatgactactcaatttaataagcagatccaaagatttccatgtgaaacttcactatagttttggagagttaatctgttaatcttctagaaccctggcatagcccattattagaaaaatgctaaggtctgttttgaaatcttcactgcagatcaagataaattaatacttggattatttgtattataagaactatcttttggaacagaccagtctttcaattacatatttttttaataagcaaaaagcctaccatcagggaaaatacattagtagtgttttcccttgtaatagttgctatcctggaagtgtgtacaagaatgaaagcctaagaccttggagcataagtacaccaagaaaagtaggcatataaatccaaaatactttaataccattttatacagaaaatcttatacagagctttaattctttgcctcaaggataattccatgttatttttcttattaatatcagtggcgcctatcacagcatgcataagcacaagaacttacaataaccagaaatcttaaaaaatatacactaaaagagacatttattaaaccagaaaatgagccaaaagggagtactggtcagagatgaatcatttaaaaaccaagaattagtgaaaatacaaagccacttagtccacaaacaaaactaagtgcaaagccttctaaaacacttccaaaagaaggtaataatactgttccccgcttcccacttcctaaacacaaaaccatatacccagaaggattacttactataagagttaatgacctacttggtcaattccatcccacccaccaccaccttctcttttatgaaaactctattaattaaaagctgacattcatttaggtttcaatgcagaatcgctcaaagaatatcgtttgactggctcacttatggacagacaacgtaaaggcctatgttagctttagttttaaagtaatatgacaaacacaagcaaataagagtttagtctaaggaaaaccaaacggtctgtatctctggaaactttcaaattctgtgatccatatcaaatggatcaaatattgtaatcatcataggatttgttaacattagatacaagtcttgcaaaatgaaacacgttaggacctggctcttatgcctgaataggatggctttgtaatatattttatacagtatttataatcctatgaataaatactttaaatacaattactgctattaaagaaaacacagacttcagtctgctagatttgttttcttcctcaaaattaaaacttcccactatttctgaataatctaaccaactcttcataaaaaggcaaattgggaggtgtgttttagttgttagaaaatatttttaaataaaagatgttattaattttaaagtctttcaacgtttaagacagacaaaatcttctacttaaaataagttaatctgattgtcataatgtttttctcattagcttacgtgtagctcctttttgcctttcaaggactattaattactctttgtttattatttggtgctacttttatctatgtatttgtaacaactgttctttagcatatttgtcgtttggatttcttactcggttaaacttatttccacatagagtaaatccattcccttatcaggatccaatcaagctgaaactgtagtgtatcaactctttaaaagtttcttatttatgaacggttgtaacttctataacagactacctgggttaggaaacacaatttccaagaggcagaggacataactgaacctaaataactccctaagttctttaagcatgatgattaaataaatcagataatatactacttatagctaccatatctcaaaattaaggggcgcaataacgaagttttaaaaaggaaagcatagccttccacttcctttaggcctattaaagactgaaaataaacctcaattaataatatgcatttatcacgacagggtttttaaaaaaggatctagtttagattaaattatatggtggaacaataaaaaagatttaataaaaagaaattgaattcttacacaagcttatcttccgaattggtcatttcccctttatccataacagagctgtctgattttcaataaatattttaataaagcatactttgaaataccaaaagtttgttataacaaccctacataatgtagttttaaaataggcactttgtttgctaatatagaaatcacaggccccaaaaaagagttttctagcattataaactctgagataaatcatctgctggtatctaagctcagtattattaatacacaccaatagtaataacaaagaaatactttcctcctagagcaaatgtataattgtttatgagctgaatatttagcttggagaggagagcaaagtgagtttagttcaaaatttagaaacccttgtatataatgattagtcaaatagcatggcataacctgataaacagtccgcacacctcattaaaattattcaaccaaactcagcatcatactttaaaacgaattctgctgatttttaatagtccacttataacagaccctaaagattctaaaaagcatcgaatctcaagaaatatggctaaagaatgttattatgtaatcagaagcttcttccttgcttttatatgaagaaatatataaacatgtctcccaggaatacagctaaaactccaataacttctttgattataatttgaattcaagccaggatttctgctggtttgaatttcacctggtggaggaaccaaaaaacccactctgattctcctgatctgtgtagatggtactttcaaagtctcatcaagaaaagaaaaaaaaaaactgaaatgaaggaaggggaattaatatgtccataaaacaaaacaaaacaaaagaaaacaaacaaataaacagaacaaaagagaaccaagcgagcgaatgtgttggtggtagcagcacccttcagcaaaaaaagtactcacgcagaatctactggccagaagttgatcagagtaacgggactgcaaaacaaaaaatgaggtggtgaaggagacacacgcaaactcagccgcaaaaaaatttactgaaaggtcaaaataaataaaatccagccaattaagtatgaaccatggaaagcaatagccaaaccaaggtgtaaagtgaattaaaagaaaaacacacagttgtgtgactgccatcagagttaaggcaaaaaagaggagcaggttgaaaagaggtgaagacgtcccctttgatcttgagaatcattactacttactgtgaagtagtttcctgtgactatattttcttttgagtagaaacaagtgactagatatgaccacacaatgagatacaaaaagacacacatttactgatttgtgagagaggaaaatcaaaatgaaatactggaatcactcatttgtaaacagtcccatatttcttataaggcttgtaaggcaattagtggctgtattgtgttgtggtttttttttttttttccccctgtgagataaagtttaacttttggaaaaagaaattgtcaagtgacgtgggaaagtggcaactggacatcagcttatttttctcttttcagctaatgtaaataaaaagaaagaaatagaagagactgtttgcatttgggagtgaaggagggtgttcagctgagaggagttcaaatatacatcaaacaagagtgtgttctgcttttgctactactcacgtttccatgttgtccccctctaagacagtctgcactggcaggtagcccattcggggatgcttcgcaaaataccttttggttcgaaatttgttttttagtaccttggcaaagtctcgaacatcttctcctgatgtagtctaaaagggagatcatggtgagatcagatttaggacaggatgatttcaaaactaatgaccactccagtcttctgccccatgacacttgttttgtaattaaggagagtgttgtggttgtgagcaaaggctttggaatcagacaaatggggctctgaaaccaggcctggcatgtactaatttggctgagttatttacttctcagaggctctgatcatcagtaaaatgggagcaacaacacctcaacacgttgttatgataaataaaagaaacatacaagcttactaggctactcaataaatggtagtttataggtcttaaggtcaaaaaggtgacattaaattttaccacactttatggtattttaaaaactacttagtacaaaatgatagcatgcttcacccactaaatttcggtctattcatagcatggtacattctcaatcactgaccatctctataagaggaataaaagtgagacaggcaaatatctgggaggatcactctgatgatggaagagagagatgctctaaagcagagcttctcatactttgttgtgtatgggaaccagctgcagatctcgctaaaatgtgggttttgatttagagcatcaggagttggggcctgtggtttcacatttctaataaagaccaaggtaatgccaatagacatatgatgattagtcaacagaccgtatcttgaatagcaagcatgcaaagtttagagaagaggagactgtaagaattaaagaaagagaagagaaacacgaagggtggctctacagtcaacagggacaggtttattttagaaaaaacaaacctgagaggagcctgtctttaattcttaggcagatttgtactcaggtctgtctggccaccaagtctacatccttgccatttccctagtgatttttcacagttctattggccacttaacattttcctaaaataacatcttaggagatggcttcaactcttacttatagaaccttgagtaaattatttaacctcaggacctcagggtcctcatctgtatagaggggataaaaatcatagtacttattttacacagggtagtttaaaaggtaaatgcctagcatttagtaagtgttagcatataaaatggatttttaaaatgtcactagtatacaggacagataataggtgagcaacattgattaaaagtggtagtttatgaatttgggggaacctagaaccatcccccatactcaacatgcctcatggccataagatcgccccacacaacctctaaggctgtgcaaaataaacgtgaaaacgtcttcaatacaaccatgcacacagaatgaaaaccctatttattcatccaacaatatttattgagggtctatcatgttccatatgtgccaggcactcccctaggcaccagggatagggtaaatcctgaagcctacagttgagagccactttagctggggaacatctggggaagtgacaaatcacagcattatacatgatctgcagtattgtacaaaactgaaatttatcccaggtgaactaactctcacgtcaggctggcgtcaaacttaccggagtgcaatattccaccatgggatagtgcattttatggccttttgcaactcgaccagaaaaaaagcagctttggcagatgtcataattaaagtgctttagactcctgtacctgataaagagcaaaaacaaacacgtatgtatttcttcgaatcaaattcccaaagaacactctttaataaaccttctaccacgttctaatttgagaaacagaaagcaatgttcattagtcccacaaggtaagtgattaactttctgcctccagatttttccggtgcctctcctacagtaccaaaacattttggcagaaagattatcctataaacatatggaaggagggaagaaaaactcagcttttatttaaactccactaggaactctttgagattaagtaggaaggtactggaaaatttccagtcttttgaaaaccaaatactcaaatttaaaagaacttccaggagcgacagacttacgctgtgcatgccccttacccatcatgggacaaaagttttctgaagcaattattttcaaaacattgtcaagataaagcaatttcacaagacaaaagaaatgtgaacaagaactttcaattaaaacaagtctcgctttaataatgttttctaattgactgatacgattcatcttcaaacagttactcgaatgaactcttttatctctatctcttcagaaatctctcaccccattacctacaaatgataactgaagccccaagagaacatgaaatttggattagatggaagaatttataatctgtaaatactagttggtacatttcctccattatcagaatgcgatattctttgtttcatactctcctgccttttgctttctcagataagaaccttagccaattcaaataaacatatttcttatgtcacatatggggaagtgggaaggaaagctatcttttttagattccagccatctttcaagagggggacaggaggaatgagaagtgctgggtcctaaaataatataatatgataagggcaaaagaattgaaggtgaaagtgctctttcagatcctccaaggcattcttcttctttattttataaaaatttcccttgtatacaaagcccactagctaaggaagcagagaaaaggtagcttagaaatctaatgcagtcactgtggcttcccttccccactccccacccccatggtatcatttttacctgccaagaaaccgggaaggaaagaaggtgacctttgcaagcagtacctactcactgttgtctatctaggcttcagaaacctctaaaagtttttgtaaaacctctttgtaaacagcatgactatggaacaataaacaccaaaagtaaaaaagcactatgaataaaaagcacgcaacagtacaaggtagttattagaaaataaagtaacaaaaccagttcacacgtaactggaaaagagtgtttactttgctgctaagtggattctgcacaggcatagaccatagagctagtttacaactttgtggcttattcatcactatagaaaccttgatgttgattcacacatttaaggacatcgcagtttcagaattaggatttaggattaatgttaagtgagattaattcatttaaaaaaaaatcctgtctccccaaacaggtcagcagggctaaagatttatttggccttgttttccatgatattttaagactatcagaataacctgctacgtttcctatctctttcacttctaaatgtataaggactggttgttttttagctgctttgtgaatcttccatttacttgcctactttttattcctttagaagttcactgggatactatacaaagaatgtaatcagattcacagataaagaagcaagttctaagatgctgaaaacaattcttgttacttaagggagaaaaaaaaatggtgcaaagtgaatgagagactgagctactattatggttcctcccagaatagaatcatctctcagttttataactgattcttgggaagtttctataaacaggaaagaccgtgaaaaaggaaagatggtaaaaatgttttggttccaggaaggaggaggtacagttcatctgtaatacctccgtgaagacacgcactttggcctgctcaaccaaaaatgtggctccgaagagctgaagagtgaaggtggtaagggacaccagcctaataagtgagatccaccaaaataacctagcgatcaggagggtgacaggaatgatcgatgttccagcccaatcaccttctctcccactttggagacggtacgaactaacagcaactggcacaggagataaaagatcaagtcataaaaaggtgaaaaatgatgagaaaaaaatgacattttttttttggttcctaatacctgaatccaatgattggacactctttgcagatgttacatttggcctgatgcttggcagtttctgcagcagccactctgtgcaggacgggcagccacaccatggactggggttccagtctcatccagtctaggaagagggccgcttcgatctctggcttattattagcctgcaaagacaggagggagagagaaggagggcaaaaggatgaaaggaaagaaggcaagatggcaaaggaggtgtatatcagttcgattaataagttaaacagaaaagatagaaagaacaatggttgcaaagctaggctggcttttcacagcttgtttctgcaaatgctccctgatatccaaagagctacccactcctaaggctttggtaaactgccattactctttttggctactagatgacaagaaaagaaaacaaaaccaacaaacgagaaaggtaagcaaactacacacctgagcgagactttatttagctttaatttttgaactgatacataaaagttagccagaagtgaaatgcaggtgtttactgataaaatttcaaaggagggggacaactgatttttttttctagagaatctgtttctcatagaatcataatgaggggctttaaaattcatctggttccaaagcctcatctaacagacaagcaaactgattttgtagaccagaaaaggagcttttcaaaggccatacagctagcagcagagctgataatagaatccaaacctcctggcttagcgctgttttcatgatgccctgttgattctgtctgcctctctatttctctctctttcaaagtctaaatgtaagaaatacaattcatcccagacaggacaatgatctcaacaatctcaaaataccaccatttgatttatatgttactatattcatgaattttaattataccttgtttttttcaaccctataggattgttttaattttttatattattagatagattgacctatatattgactacttttttgctcttcattgctttctttcatctcaaatcttccatctgggattagttctgcctgaaatatgtcccttagaatttcctttagctgttggtggtgcatttctcaagctctgtttgtctgaaaatacctcctttttttaaaaaaaaaatccatattcctgatagttatcttcattaaatacaattttttttttttttgagactgactctatctctattgcccaggctggagtgcagtggcgtgatctcggctcctgcaatctccgcctcctgggttcaagtgattctcatgcctcagcctcccaagtagctgggaccatgggcacacgccaccccacccggctactttttgtatttttagtagagatggggtttcaccatgttgactaggcaggtctcgaactcctgacttaaaatgatccacccgcctcggcctcccaaagtgctgggataacaggcgtgagccactgcgcctggcccaagtataaaatttttgattgaaaggttttggggtcttgtttttattttgtttttgaatactgaaatattactccactttcgtctatctctgttgctgctgagaagtcaatagtaaagatgactgttgctcctttgcaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgcccaacaatgatagactggattaagaaaatgtggcacatatacaccatggaatactatgcagccataaaaaaggatgagttcatgtcctttgtagggacatggatgaaattggaaatcatcattctcagtaaactatcgcaaggacaaaaaaccaaacaccgcatgttctcactcataggtgggaatggaacaatgagaacacatggacataggaaggggaacatcacactctggggactgttgtggggtggggggaggggggagggatagcattaggagatatacctaatgctagatgacgagttagtgggtgcagcacaccagcatggcacatgtatacatatgtaactaacctgcacattgtgcacatgtaccctaaaacttaaagtataataaaaataaaataaaaaaaataaagataatctatctgttttctatcttgtgctgtttctaggatttgatttagactgcttaggattcactggacttcttaaacctgtgatttagagtctttaatcagctgtggaatcttctccgtcattctctcaacaaatagtgcctcttctccattccctctccattctactttcagaactctgttacataaatgttactcttcttcaatctatatttctctgaacaggacttccctagttcccccctctctgccccacatctttttaaaacatccttctgtgcttcattcttattaattccttctgccttactgtctgggtatccatttctcttgccggtctgctgtaaacccatacagttttaaattttgattattgtacttttgacatctagaaatactacttggtcatttttaaggtaacttctcaggtttgtggttccctgtagatatttttcaatgttgttttttatttttctaactgcataaacacaattaagaaaataatctgtctaataattctggaatatgatgttatcgtaggtctgcttctatggtttgctatttcttctggttctcattcaccttgatttctttctttttccaccttgatttcttgtgtgcttaatatgttttttgttttttttttttaccacgtactaaactgaccttaccaatattttctagagataaataaaagcttgagcctagaataaaagtgctttctccagagatgattctcctttgcttttgccaagaaccaagaagcattacttattccacagccaatttcagttgaatatatgacatgggaatacttagtatcacacaagtcatgggtatttgagctgcaaagccaagttgcttctcttgtaatgtggtttcctaataaaggacatatccacatttcagatagaaaggcaggagggtttagactgacaggtcatttggcttataacactgatcacctcaacagcactccagtcattacccctaattctaaatttagcaacactataataaactgtttaactttggatttcctagctgcaaaatggtatcagttcaaacttccgatcaaatgctactgtttaccaaagacctagaatcaatctaaatgcccaccaatggaagactgaataaagaaaacgtggtacatatacaccctggaatactccggagccagaaaaaagaatgagatcatgttctttgcaggaacatggatggagctggaggccattatccttagcaaactaatgcaggaacagaaaaccaagtattgcatgttttcacttataagtgggagttaaatgatgagaacacatgggcagatagaggggaaaaacacacactgtggcttatcagaggatggagggtgggaggagggagaagatcaggaaaataactaatgggtattaggcttaatacttgggtgacaaaataatctgtacaacaaacccccatgacacaagtttacctcataagaaacctagacaggtacccctgaacttacaagttaaattttaaaaagctgttgctgagcacttttctctgtgtagagttccatcacagaggtactttgtggaaaaaaaagtttataaagaattatgcaatctaaaaatgaaaaagatcatgcaagtccattcatccttttggcatggcaccacagagctgtaagactttcaggattcactgagtccaaactcagcattcatcgagtccaaactcttacccatgccagtgtgtgcttacagccactacaccacccatgtgagagagctgggaaacatccttagaaggtgatcctgaacacctgtgtccagatacccctgtcaaaagtgctgcatcacattgagctgaaatccatcagcacagcatatagaagttccagagttaaaccactggagttcaccactcactggctgtgtgaccttaggaaaataactttatctctctgtgtcttactttttctctgctacaaactggaaatattaatagtgcctacctcatagagttattttatgattacgtgagtcagcaaatgaaaggcaattggaaccgtgtctgacacatagcaagaatcatgtttgctattgttattgtcattattattatccatctgaccagcaacccagaagttcttggtctttgaacagccctttaaatattttaccagagctgtcttatctgtccatgcctcttcattcctattctttttacttcttcttcatatgacacggcttagtttgccattgtcatttagaaaactattcttcaaatatgattgcggagaatgtacctctatttctccagacagtgtaactggattactttcttttgttctgtaccgtaggctcacacacggttcctactcaactaaaatctctgagtcagtgtttcccagtatgtccagcagatcaatcgtccagcaaaatgcttcacgagaaggtcaaattaatgaaagaaacagtgcacattatatctgcctcttaaaattcttagagcacgttaacatattaaaagctgagaaggtcatcagtaaagcaacatgttaatcagctctggaatcttcccagattctcagagagagagagagagagagagagagagagagagagagagagagagagagagagagagagagagagagagaacaagcaagagtgacttctgaaggggcgatttaataacagttttcaattatgtgaatggctctcgcataggggcctgtgaccagctgttcgatctctccactgaggacagaacaagaagaaacagacttaagcagcatgaagaatttaggctgtagctcatatggaagaatttcctgatgctgaaagttgttaaagcattagtgtgaattaccaagggaggctgtagaatgttctactctttcaaaaaactatagattcttctatgcttaaaggttgaacattctcaaatttctagcccctaagatgcaagatccatcatgttggctcttttaaaactgctcacctacgccaactgacagactgaagacaaggtacggggattcacgttctcattctgtttcaatctttcatttttatgacaaactactctgtatcctagtggtatattccctctccttttgtctggcaatgaagaaggaaagaattaaaagccaggcaagcttctgtaaagacctaacagaactagaattaaacccagctaaaattacatttcgatcattccagaaaaaaatatatagggatagattggaatagcaggaagttattaaggtcaaaagataagtatgatggcattcactggactgagataatctttgtaagtaccattatttgttgagatacatataagtctcagatataatcccctctcagtatcaagggtgaccttgtcctcatctctaaacaccagtttcaagccatgcaagcaaaatctcttggaaaggtcatttagccctgggttttgttttgtttgttggctttgttttgcttttgctgttgttttggcaataactccattttccccttctatgtcatgcacacacagaaagcaaagctatcacagctccttccattatgatggtcacagtttggaattatgttgggtttctcctctttttctgttggtcctcacctgccagcaactatccataacagaaaagctaggggaaggaatcagttgtcattactattgctctgttacagcacactggagggtggcttcatacaaatatcacctttatacaaatataacaaggtacacagacaaagaattctcaatatctggaatttctagcaaaccgatttacctatcaatataataagtttaaaagggcattacatggcaagtttggaggtaggagagttgctggggttccgaagaacttttggatttctttgatgttgtgctttctataaatccttggacactgaagggccaaccgcctgccaggaggtccacctgaatactcatttttctctcaaggtaataaaatcaattcatggctacagaagaaatgcaattaagtatttctcagcaagccctgcatcccagctaccatgaacacgtacattgtattttttaggagaaggcaattggcatttcaattgtgaggtttgtgaaaaccatgtgaacacttaataaactacaataattagtacagtcatccctcagtatatgctaggggttgcttcctggcccgccgcagccccactcccacggggattttgctgttgagatacagcaaaatccacgcatacgcaagtcccacagtaggcccagctgaacgcatatccgcaggtttcacatctcttgagtactgcattttcgatacgcatttggttgaaaacgatccacttataagtggacccacacagttcaaatctatgtttttcaagggtcaactctatatagagaagtaaacattgggcaagagactgtgcccagtaattctcagataacaagaaaccaccatcctggaaacaatacagaacgatacctccttaatttctttcctaaattgcagattaattaaagacaggaactatacttctggagtctctgttaaaatctgctgaattgaacagtgggtgggaattcaactgcaatatgatcgcaagaaataaaaggaagattataaaatctgtatgaagtcagaattttaaaaagctgcctagtcatcctgaagagcaaaaacatacacttgtaaagattttataaagagcagaagacaaaataagttactttctcaaactgtccaaaatttcctttatcgattacagtaaatgtccttgtgttggtttctatgtgatggtatcacacataaaaggctaacagacttcatctggacttagaaggtatgtacagaatgatctggcttaaaatataggtatacacaaaattcacacttggggcccttgaaaggaactgcacaggcagatagcttttctctaggtcggtggttctcaaccggaaatgatgccgtaccccagaggaaatataacaatgtttggagtgtcgaccaaaaaacatcagagaaaaacatcgccaaatatgttaaatttattttggaattagaaatgaggattacaacccaagatgcatctgaagaggagactgtagagggaaacttttattggtaaaaacagaagtttacataagctgcttggaaacatagttcgtttcagatgctcaacgccagaactggtgtcagtttattagtggggatgccattactgggcagatgttcttttgagagcatattacgtgcactgctgcagtcctaacagaggaatttcttgtggggcgattttagaaagtccttgagacagtctttatctcaggcatgtaaccatgaaccctcctcctttcatgctgccctggctctagttagtttgggactgacaaaaagtgatttcatcctggtatcttttacgggagacatttttggttgtcacaactgggcgggggggggggggggggggggagggggagggcggggagggggtgctactagcatttagtagatagaggccaggattctgcaaaacatccagcagcacacagggcagcttcccacaacaaagaactagaatgattcgggccaaagcatcagtagcaccaaggttgagaaaccctgccccaatgttaacatcttacataaccatatggttcacttgtcaaaactaagaaatccacattgattcatcactattcactaaacaacagacttccctgagagtcctgcaagggcatttaataagccggcaactatcctctacaacacagaaactgggaggctaccataggcctattcaactgccgaaatgccacactcgttcataaactgagggtagagagagcaaaagggaaattaaaagccccaaactagaagtcacaaggaaacacgctaaaattgtagactcagatttgaaatcaagttgcttctcaaactgacaactctatgcagtgtattccaggataaacagttgcagaaatttatttatttaatcatggcagataattatcccaagcaaggtaaagcaggtctgctagtacaatgtgtatgtgtgtgtgtgtgtgtgtgtgttttgattttacttagtacaggtcataaccatttagagaaaaaataagaactaaatatgcaaatattaaatacatacatatccataaatagaattcctaaacatttttattgacagaaaaaggtaaatttatggaaaacattgtgggcaaaccacagatttttaaaaagggtaatctctcctttgtggctgatatggtttggctgtgtccccacccaaatctcatcttgaattataactcccacaattcccacatgtcgtgggaggagcctggtgggaggtgattgacttatgggggttggtctttcctgcgccgttctcgtgatagtgaatgagtctcacactatctgatggttttaaaaacgggagtttctctgcacaagctctttttttgcctgctgccatccaggtaagttgtgacttgctcctccttgccttctgccatgattgtgaggcctccccagccacgtggaactgttaagtccaatgaccctctctcttttgtaaattgccccatctcaggtatgtctttatcagcagcgtgaaaacggactaatacagtggccattttcatttgctattttcattagtaacatgttcccttcataaatccaaaaaatcatttcaatgtcattgccattgttaataggtattggcattaatagctgacaactcaacttttctagccctcgttataaaaagccttagcatttggaaagatttgctgaatttaaatttataaaaactgttttttgaattacagtctgtacacaaagatttaaaactacaaggagaacggttagtcagggtcagacagtataggacaggcagtccctgactgttccctgatctgttattacaatttctttaacaacctctaaatctaccaagggcatcagtggaatattttacataagagagaagtctgcaccagcagagaacataaaaggaggaacaagaacaagctgtaaagaatattaatgactcttcttccaaacaatcccaatttttatgaaaatcaaatgagtgataaaaagactctataaaactatacaaaacctgcatgtaacaaataaaacagaaggaaggtgacattttgatcctcttagacacaagatacttgggttttacctttgagttactgaggaaactatagtgtacggacgcaagggatcatttacatgaggttgtacacaatggtttttcacatcttgctcttagtgtgtgtttccattcagagaacacttggtctcatgtgaaatgccacactctatgtacaagactgttttctatatcttatagctctgatacaagagttgttacccggaagatcaggtaagactttgctgatcatggccaagctttgaaataagtacaataatccatttccctttcggcctttataacatttagcatagaatcaaagacacttagggataagtaacttttgagataacctgttttaactttatgttacagataagaaaaggcccaaagaggttaaggaaacagcttaagattatctacgattttaatactgaaatatatgcttaaaatagtcttaaaaagacaggacaaaagtgatttcctatgggaaaaagcaaggcgatccccaaaatcttttgaatctttaatttgtttgaaagtactagagtctgatagctaagtaagcaaggcccacttaggacaatttccaggtgaatataaatcttcaactgaattatatgccgataacatggctgcgagagccaatggaaggtgcaagtgaataccccacaacactgataaatgcatacttatatctcatctgatcaactcctttcccccttcttttcagcattacatgtccctcgtaccattagatgctacggcatgtatgagctacctggactgacaggtgcgggtccatatatattgaagtggcaaaaaggaaaaaaaagaaacaaaactctatgagcttctcaattcagcacagttttcatgttacgtgttttaattatgtcaatgtgttgttcccataaaaggattggttaatatggaaatgtatttattagacatctgtttatgtggctctctggagaaaggactttcaattccatacactgccattttaaacaattccaagacaaaaatagtatccaatggcagttcagtaaagagagatatcattctttgtacactcagaaccaccttggatgtccacagtgatattcatgaatagacgggggagaggtagaagctcttctttacataagaaaatggtctaatacatgcagaaagtatggtagaattagaaagccaccattatgcaaccaccaatattataactgaattagacaaggatcatccataaatgctaaaaccatagggtaaaaggttaaggaatggatattataatatgtcaaaatatcaaaaaattactttctcattacaaagggaaaaggatattttacaaggaaagtatcttgtagacaccaccttaacattcttagtgataccaataggaacaaaatgttattttgttcctccagattgtgatacagtggtaggtacagagcatcatcttatcgtcttttggccaaaaaatgttaacattaatctaatcacaaggaaaccatcagaaaagcccagagtatgggacattcttcaagagaactggtctgaactcttcaaaaatgtcaacgtcagcccggcgtggtggctgatacctgtaattccagtactttgggaggccgaggcaggtggatcacctgaggtcaggagttcaagaccagcctggccaacgtggtgaaaccctgtctctactaaaaatacaaaaatcagccgggtgtggtggtgcatgcctgtaatcccagctactcctgaggctgaggtggagagtcacatgaactcgggaagcagaggttgcagtgagccgagattgcgccactgcactccagcctgggtgacagagcgagactctgtccccctaccaaaaaagtcaatgtcatgaaaggaaaacaaaatgctgggagactgttcaaaactaaatgaaggtacagagacatgacagacaaaaaccttgactagatgctggaagaaaacagtggctataaggaacaattctggggcactggggaaagttcagtgtggactgcatatcagagggtattgctggattgctgttaaatttgtgtgtaacgatagcattgcagttatgttagagaatgtcatcctttaagaaaatggtgtatggtgaagtgtttaggggtttatgttgtgatgctcctttacttttaaatggcataggggaaaatgtgtttgtgtgtgtatgtacacagacagacacatacataaacagagctgagagggtggaggaggtaagtagagcgaaaagcaaccatggattgaacagatgtatgacacagatgagtgttctttagactatcctttcaactactctttgtgcttgaaatgtttccaaaataaaacgttggttggaaaccgttatttctcccaagtcaccccttcatgggaataggttgtgggcaaggcaggagggtgggcaagagtgattttagtaactgtgaaagggacaggacaatggtattaatgtcaatagtaatgagtgtgaaaagttccccaggattcgttttctctaaaaatacaaacctaacgcaaaattgatttccttcctgtccttgtcacggttcttaaagcatctcctcatcgactctgcctagatgtgcttttcctagatccctaaatgtgaatctccaggcatgaaaatgagtttaagagtccccacatgcgcagaagcagaactttttgtttaaggattgagaggtcaagagttgtctttgtgagacaagaagaagtaaaaggcttcccataactaccatcttgggtagaaatcaagtattttatttaaagttctgaagataatgagcaggtaggaggccagcagtcactgctctaaatattaatcaggactctgaatcacccattaaagataaaatcagcccaaacaataacacatggtgattatccactcttcatttccatgttcaaggacaactgtcctgacctcaggctctgcactccacctgactaataaaccaattaacgccatggccctagggaacatatgcacaattttaaatctatgcaaatccctaagtatactcaacagtattaatttatgctaccgagttctaatttaacaggaaagttaaattagaaaagtttcacatatacatggtaaagcacatatatctgtctataggtaccatggaatatactttcccaagtgtggatcagggcgcattatgtaaaagaacaagatataaagttagctcttccactactgcctcctacaatcctttaaaatccagttcaggaaaaggcaaaattacaggaacagaaaacagagctgtggtttccagagattgggacttagtgagatgatacagcatgatggaattttaggggtgatagaaatggaaggaagaaaggaaggaaggagggaaggagaaggggacagagagagggagggagggagagagagagaacgaaagaaaagagaaaagaaagaaagaaaggaaaggagaggagaggaaaggaagagaggcgggagggagggcaggaaggaaggaaggaaaagacagggtgagaggaaggaaggaagaaagaaagatttggtcataacaatgaagtgctactttagaaggatgaagatggaaaacaaaatgacatgtgcttttccttagcagtaagtgtataaacaaaacaggtttcaactacaacacaaacctatcttcaaaattctggtgaagaaaacatccattactccaatagagaagttaatcaaacaaaccacttaaacagatcatcataaagcttaacccacggtagcttaaaatttttaaaaataacaactggaaaccaatattaaacttaagacaatactgataatactctgataagggtcttttctgaaaattgcaggaattttaactaactgttcatgagcaggcccagtaagaggtcggtgatatctctcagcttttcatggcagccagctatctctatggaaggctgattggactattagggtctaccttcaattctgggaaaggccacctctttataaataccaaattgtagtaactcttactaattacttagttactagtgagtattcatccgtccaaaaggggtgtaaaaggaatgtctatggaaccaaagggcccacagtctgattaatacacaaaaagccaaaggaaacctaagtgaaggagggtttttaggagttactttcaggatggaaaatctattaataaaatggaatcggccaggtgtgatggctcatgcctgtaatcccagcactttgggaggctgaggtgggcggatcacaaggtcaagagattgagaccatcctggccaacatggtgaaaccttctctattaaaaatacaaaaattagctgggcgtggtggcacgtgcctgtagtcccagctacttgggaggctgaggcaggagaatcacttgaacctgggaggtggaggttgcagtgtgccgagatggcaccactggactccagcctggcaacagagcgagactctgtctcaaaaaaaaaaaaaaaaaaaaaaaaaaaaaaaaaaaaaaaaaaaaaaaagtaatcagttgacccggggaatgctgtctaaccagccaaaagtctcctgatatggcattttaacatttgcagagaaacagaatctccagaatctctaaaatgcaatccacagatgatgttttgttatagataaaagcaactgttaacattggcaggatattttcatgccacaacacactttagataatcatagctaacattcactgggcaccttctatgtatccactacagctcttaagtgctttgcttctattggttcatttaatcctcacaatcacctccaggagttcaggggccaggaaggttaagaaatgtgtccacagtcacacagccagcaaatagcagagctcagatttggactcaggcacagttcggtttcaaagcctatgcacttaaccactctgccagtcacttctccagatattctggaatgctttctcatttatgtgttactgatcctcccacctcagtctcctgagtagctgggactacaggggcatgccaccatgcatggcaacaataatacattgtatatttcaaaataactaaaagagtagaattgggaatgtttctaacacagagaaatacttgttctcaacagttgagactgtaatttattctcattttcatatcattctacattattacaacaactgtgcatagatggtattcatttttgtcatacaaatagagaaattcagaagatagatggaaaagcaacttactcatttggaatactaagtacaacaggaggcagaaaacagatgtaaaataaacagattttgacactccagctctcataggtgaagcatattgaatataaagttggtatacttgacgttatctaaacaataaagtccttaaaatgtttactgaagaagatactacaaaatcgaaaccacaaaaagatatctgcactcccatgttgactgcagcattgttcacaatagccaagatatagaatcaacctaagcgcccatcagtggatgaatgcataaagaaaatgtactataaacacataatggaatattattcagccataaaaaatgaaatcccattatttgcagcaacatgtacggaaccggaagacgttatgttgagatcagccacacacagaaagacaagtatcccatgttctcactcatgtgtgggagctaaaaaaaaaaaaaaaaaaaaaaattgaactcatggagatagagtaaaatcatgactaccagagtctgggaaatgtagtgaagatcgggggataaaaaagggatggttaatgggtacaaaaatacagtaagaagaaatatgatctagtgtttggtagcacaataaggccactatagtaatcaatatatttttaaatctttttacagatagggtctcactatgctgtccatgttggagtgtagtgactattcacaggtgcaattgttgtgcattacagccttgaattcctgggcgcaagtgatcctcccacctcagcctcctgaaacgctggtcctacaggtgcgtgctaccatgcatggcaacaataatttattgtatatttcaaaataactaaaagagtgaaatgggaatgttcctaccagagaaatgatgaatgtttgagatgatggacaccccaattactctgattgtgttaccctacacattgtatgcttgtatcaaaatatcacatgtaacccataaatgagtactattatgtgtccataataattaaaaatattttaaaacatacttttttacctgttaaatgactggcagtgcaggtttgtgaaataattcttcgtgctatgatgttacaatggctacagtgtcacaaagtaatgcgaatttttcagttccattataatctcttcttacgttgatcttatgggaccaccatagtatatatggcctgtcattgaccaaaacgtcattcttcagcacatgactgtatagttttcccacctaaaagtgatacttggttttatctgaagatagactaaacagctatgttgggattagagtattttcaataaagatgggtgtgtgtgcatgtatgtgttttgggggaggggtgtttatttatctatctcattctattacaatctaaaattcatataggggatcacattgacacattaacactctgtcatttcaatctagtctccgaactggttgaagccataacatgatgtaaattgcacgatgtagactagattcattgtgccactgtgggcctgttttctcatctgaaaaaggagaggtgcagaaaatcctcaaggttccttcaggcagtctatgtgactcactgccagggcaggcttggccttactaaggtcgtaaaaatcaatctaatctctcaacagggctgtttccatggaatatgagaaaggaacaagctggcaatatattaattacagctgtatctcttaaactcgttgcaaaactttacttctatcactaccaaaatgagtcaatttcccagtaaatgtgttgactgcaatatgctattaatgtggaaacatatcctgttgcctcatttagtatctacgaagataccactgtcaaagccataaatttacagtgactattcctttttcatatccatggatgtgacttcatttcctggcttaatggataattccttggaagacctatagtgatttttaaataagcaaaattttacatttagacctgataggtgatttccttttctaagtggttagtggggagggatatgagaaaacctttaatagataatccagagagtgtggcacacaaacacgtacctctcttcttgccactactgggcccttgtctgaatcagaagattcagtacctttctaactgtaccaacctgaaacaaagtaaggtttccaggtggtgacaagaaatcaaaggaaatcaaatctgcaatgcaaggaatgcacttgtaggataaacaagtactttattaccgtttacctcaggctggtagaaatagcagcctttgagcacaagcttgctgaaggaaccagcccagcctcattctgaaggtcctatacttcaaacaaagggcagaggacattttcactcctgttatctttccctacagcaaacattgtatttttatgcacgtggcacaatgaaaggcaaggtgaccgccagtgcacctggccgaggaaaagcatgccagggccaggacgtggattcctaagtattcctaagtatttacaatggatccattcaacctgattgcaaattgctaaaacgctgagaggctccccaaatctaagtaatgaaagcctcgccatacatatggaatttactagcatctgattagaaatactacatttgccagcacttcaaactaattcctcttccccctcaagggtcccctgtcttgttataccttttcttattctatccaggactcaggaaaagtagctgttgtttggccttgggaagctggagagcagaagtatcagaaactacatatttgggaatgaggtagtaaatgtggcggtgggcatactggactaggaatcaaacccttccaccagctgagggactttaagggcgcaaataaattattcatccacttaaacaataataaaagcaaaatctccaaagcctgactattctgttcccctcaaagacttggtgaggattaaatgagagaattcatgtgaacaaagttttgttagtagcaatggtaacaatattatttataagcataataggtacaaatggtaaggagaagctgtttcatgatagtgaaagcaaactatgggtggttatgaaaccagagtaggaaaggtctgagagttaaatagaggaattaggatttgttcactagacaacagaaagatactgacattttcaaggacggcatcatatgggaaatgcttttctctaaaactagtatgagggcaataagaccaatgaaaaggactggagtgtgaagtggaggcttgctaggaagccagtgcaatgatgagaaggcctggaaacaatgtaagaatggcaatggaaagcaatcaaacaaaacatgtttctttccctaaaaaaagaggcagcactttactaattttttttctaattataaatgttcaaagaagaaaactcagaaaataaaaatagtacagagaaaatcaaaagccacctgttaccaccattcatatcttgactgatttccccccagtctcatagaaaacatttcaaggctggatgccgtggctcacgcctgtactcccaacattttgggaggctgaggtgggtggacagcttgagcccaagagctcgagaccagcctaggcaacatggcgagagaccctgtacacacacacacacacacacacacacacacacacacacacgcacacacacacacatacaccaaaaaaatgccaggcgtggcggtccatgcctgtagtcccagctactcaggaggctgaggtgggaggatcacttgagcccagaggtcgaggctgcaatgagctgtgatcgtgccactgcactccagcctgggtgacgaagttagaccccttctgaaaacaaaacaaaacacatttcacatttcaaagagcttggagactggctggccaaccaggaggcattcaacaaatatgcaaggatggactgaattcaaagctttgagactgagaatacagagttgttattacagagacagaaatgtaaccaaaccagagacatgggcttaggggagtaggaggttatccagcaaaaggatgtagcaggcagaaatggaataggttggtctcctgataaggggggcagcccagggaaagcagagcttctgtatggccaccgcttatcctgacaaccaaatccaagagggccagaggctgcagtgaggatggtggtggcttcctgatgagtcagtactcgggcgagaaaacaaagaatccagctggccctgaatacagcctagtttactttgcagcagggaccatcactgagccttacctttaacccaagtcacaatgcacacacatatgtttatatatccctatatatgaacacgtgtgtgtgtttcactagaactcaaagagtaactgagacttgactaaaggggaaaaatgattaggacctgtaatcccagcactttgggaggccgaggcaggtggattgcttgagatcaggagtttgagctcagcctggccaacatggtgaaaccctgtctccacaaaaaattagccaggcatggtggcaggcaccctgtaatcccagctactcgggaggctgaggcatgacaattgcttgaaccagggaggcggaggttgcagtgagccgagatcgcgccattgcactccagcctgggcgacagagggagactccatctcaaaacaaaacaaaacaaaaaaaacacacaaccaaaagattaggaaataactcgcgtttatggcaagttgttttataattggattttaaaaaatcaaaatgaacctagattgcctgtggccattaatattcattgtatggaagttacttgtgtctacattttgatgattgattggattgatcatctatctgcattttggaaggtttgggtatgaggaggaaaagatatttatttctccacatgcattttacatttacaactaatttgccataattttggcaaaataattcaaacagtatatcccactttacataaatgaacttattatgtgtgcatccggtaaatctatccaactaactattaaataaatactcaaactgctttaaacacctaaatattcacagtgatctgcccaggaaaccttctatagtttcatcctagtctgtggtcaaagacttcagatataacccagttagttctacagctagttccattttgtaaatctcagccattgttaatagaattagaatggattgagaaaccctacataagaaaaacagctcttagcacttgaaaaaaccaaaaacaaaaacataagaacactgtgaataatgtgataccgaaagcatcttactccttcaatactgatagcgttacaattagaacaacttttgaagaaaggccacaaaaaatgtttatattattttgtctggcaatcacacgcctgagaattgatcctataaagaaagcttcaaagacaaaagctaaacgataaggatgttcattgtagcactatctacctaataaaaattagaggccaggcacggtggcttacgcctgtaatccgagcactttgggagttcgaggcaggtggatcacctgaggtcaggagtttgagaccagcctggccaacctggtgaaaccctgtctctactaaaaatacaaaaattagcttggggtggcggtgggcgcctgtaatcccagctactcgggaggctgaggtagcagaatcacttgaacccgggaggtggaggttgcagtgagcagagatctcaccactgcactccagcctgggtgacagagcgagactgcaactcaaaaaagaaaaaaaaaaaaaaaaggaaagagaaaaaaaaattagaacaagatgaatgtctaccagtggagtgctcaggcatttgggaagaagagggtgtttctggggcactgactacgacagagaaaaagcaatgggacaggataggaaagagaacggacaagagtgtgttcagtcagtgatggacattagcagagagtatacacctctagactttggaataataggggaatgtcaaagctacaaaggacagttttaaaaaaaaggacagctgtgctaacaatttaccaacagccattgaaaggaggctataatgatagaattagagaaaggactcagagactaagagactcgcctacaaaggccattttcttatatacataggatttctgtggctagagacttatttcctcccttgctgaacttcttcccctctagcacctcaataactgtggggtccctgctgcagatggagatttcttttccttcctcagcactgtcttctttcccaaaacctagagttccagaagctgcttacttacagaggttccaaatatcccaaatcccatacctactgcctactgaagagctaatatgagaaaacgaagctctgtgggttttttaattaatttctaaaatatgaaagaataaatatgttacctagaaggtgaataacttacaaattggaagcagctccggacacttggctcaatgttactgcccccaaaggatgcaacttcacccaactgtcttggaatttggatagaatcatgcagaaggaggcccagcctgcgctggtcacaaaatcctgttgaacttgccacttgcttgaaaaggtctacaaaggaagaagaaaattgcaacagtcaaaacacagcacccatggatgccagcagaacctgacatccaactcaattccagtagcaattctcaagagtagccagtatttccacagagtggggttacttctaatttgtgctaatctggatatttattatttttatgaatcaagttaatgatcactgtatatatatgaagtgtgataacttttacataaactgtgtcactgcaagaagcgcaagcttacacgtaccctcgacacttaaatttcttctaagccagaacataatccttgggaattattgtatataggatgtaactacatcaaaaaataagtgttttagcattaagagacatataactggcccaaagcaccaccctccttggacaccagagattcaaaaatgtaccacagttgggacttctttatggagtcataagatcactgagcttctagtccatcatgtatgtgttcccacaggatactgtgcatagtttgttgttgttgttgttgttttttgagacggagtcttgctctgtcgcccaggctgcagtgcagtggtgcgatctctgctcaccgcaacctctgcctcccgggttcaagccattctcctgcctcagccgcctgagtagctgcgattacaggcacatgccatcacacccagctaatttttgtatttttactggagacgtgtttcaccatgatggccaggctggtcttgaactcctgacctcaagtgatcctcctacctcggcctccctaagtgctgggattacaggtgtgagctactgcgcctggctgcgtatttctaattaatagctcacatcatgttatgctggcattgattcaatatgtgtctatcgtttttggcaggagacttatatccccttgagggaaggaaccatatcttggtcagttgtgtgccagaagtatctacagtagaatggcagtacccggtggatagtaggtgcccaatatatgtaacagaatgaatgaacatactgaatgcttgcaatgttatgttttgttctcagatataaaattttaatcataccttatattcacctagaagttgcccctcaaaaaaagtaaatccaagaaagctttctgtacccataagcacactttaaactctaggaaattaaatgttttaacaggatacctaagatggcactaaaaattgagattgtacgcacagctttttatctgctctccgatatacatacctaggtgtttattttcaaagttatgagttactttcaaacatctcattttgcatttaatatttttgtttcaccaacctaaaaacatgttccctcttagtagttattcgaaacaccaactcaaagcttcctcaattattcaatttaatattatatttacaatgtgctgtcactataccatatatacggtagattagaacctaacctatactaagtaactacaatatttaaaggagaaaagcacacaggtatcccatctcatccgaaatacattttaaaatggttaacaaaagctgttcagttatttttctctcgttctgaggatgagaaaactcaagtggaaactacataaaagtgagggccaaaatggtttgtgtattttgtggcttactcctgaaggagaaatgatcagtaggagacagagtggcttttatctcctgcctgtcctgaagcttagcacatctcctcacatgtgtggctaggcctcaggggaagagagaaaagacaagctaggctgaatttgtttaatattcctactgaaaagattgcttataagcatttcaaggggaaaaccaactgcagcctttcacaatatgaatggatggtcacttggtcatctgaaccatcactcctctagcattggcttttaatttggttttacagtttttaagcagaagaacccaatgcgtaatcaaaaggaaattctgtagggtggtacgtatctatcctttaagaaacagcaagctatctgtctctcaaataataaaatgttagtcacgtcacggaattggatgtgtcagtacaacttgcagtaagatgattataaaataaacaatgtttcttgaacatgaatgtcacatggtattctttaaataagaacccaaagactagacaagtgcagagattaaatcttcacacttatttttccgacttacagaaagaggttagaaaatcagactttatcccctaggaacatgtgttttattcagacacagtcaatgtaatgtaaaataatacctggactggaaaagctaatcctcattctctacttaaatgcctgcaatttaatgtttgacaaggaatggcacaaaccaaattttatgacactctaaaagcagttctacatcttacatgaggaatctgctgtcaaataagaacagtctgtcatttcccatctagaactagggtaattagccaacattaataaaagaatacagcattaatatacacgacttacatctgtacttgtcttccaaatgtgctttacacagggaaatgatgccagttttaaaagacaggacacggatcctccctgttcgtcccctattatgaagaatcaaagcagaaaacaattactgaccctttcctagagggtaaacacttctagttaagaataaagccttgaaaaggaaaaataaaggagtaaagtgctcaatgatgtgtgaactctattgaccactgttttattaagattgttttgaacttttccaaattcattatctctttgactgatgacctacaatgcaatggaaattcaaccaacttgaccactgaatgtttaccaagtttcaattcctaaaaacccttatttgaactgcaaaagttctacataaattaagaaaaaaaaattctattcacctatggaaagccaccttggtttaagttggtaagcagaagaattactaatcttcaccaatctactttggttactaaagcaaattacctactttggtcatggaagccaaaaaaattaccagcaactaactgctcagccctcttaaatgctcagatcttcatcagattgccccttattgaaagaaaattaattacttcaggccacataacacataatatagaatataaatgtttatctccgtaagaaaaatatcatactctattaaacaacattcaaatatatgatctaaaaaataaatttataaataacctgttgctatatcagtgttttaatatagattgcttttatttgcatagcattttctatatttgcatatagaaaactgaaataaagcatttcacataacaaatttattaataagctaattttatccatgggggaaaaaaaggaaaaataagaatgaaaagttttccattttgtagaaaatgtctttcaagacatggaatcaatatgaatgcccatcaatgagaaatatggtacatatacactatggaataccatgcagctataaaaaagaatgagatcatgtcttttgaacacggattagctggagactattatccttagcaaactaatgcagaaacagaaaagtaaatactgcatgttctcacttctaagtggaagctaaatgatgagagctcacgaacacaagggaacaacagatactggggtcttgagggtggagggtggaaggagggagaggagcagaaaagacaactgttgggtactgcgcttaacccatttatgctggaggctgcatattactttttgtgaaaatcagaccttggcgatgaccttgagcagtaggataggaataattcccacaagcttagtgttccaataatggaacactaggcataaatgggttaatacctgagtgatgaaataatctgtacaacaaacccccgtgacgtgagtttacctatgtaacagaccttcacataataccccgaaacctaaaattaaagttaaaaagtgtctttcaatagttttttggcttcttattttattacggaaagctactggcccttagatattggtaaaaagaaaaaggagaaaatatttcagaataattcgcctattagcacttcaaaatcacaaaggataggtcccaatggcggttattttcggtgaacaatatgctcaacttccagctactaaaatttattaaatccctcagtcaaaaagaaatcctgggcactaatggactaaacaaattcctatcactggaaaattttcttatctttctccctcttaagaaaaggtagatcaaaatttaacaaatccactttatacagcaactcaggtcttcaaggagttaaaattgtcaccaaatacttttcagtcaggtagaaggaagttatacattcagaatgcattcacatgtcatctgcaaagaaaacagtgccaaaatatatttgaggggaaacctgaatacaaactcttatcaaaactaatgtgaacgtagttcacaattgaaatccgacatgttcaaggacttggtagatgactatgatgaatgtaatagtcaggtggtcctgaaattttaaaaagcaataccttatcaaaataagaaagaaaaaaaggtataaattttagttcaaaaggtagtagaagtctacaacaaaggtaaaaggcaaaacagttgttttgcaactcttttcagaaaaccttcccagatttccaaatgggagtatgttcttgattggtgaaatgaggcatgtaataattttgagatctaagaagaatttaggcaaaattaagaccaattccttctgctcccttcttcaattgtcttcattaagctcaagaaaaaaaaaaatcagaactggggatatctcccttgtgtgcaatccaaaacaaacaattgttctctaagagagagtgatgaatggaggcgccaaactgaaacttcataaaatcttattaaaaaacaaaagaaaacgaaaaatgttctcagtttgagaagctaagtttgctgtattaagggcttgttttcattttgtttggcctatcaattcataatcttctgcaaaagtgtcctaagtatcagctaagaccattctgatctggagacaggtgtgccagtatctccaggagcacagccatggccgccagtgagaggaagccacccctgaagtgcatggaagaattccaaaatccatgggcgagaaagggaaagaaccaaaggctatatgtcgactcattccactatttgcaaaatgagtgtctcagggttttgtttgttttctaatctgagagcaatctacattctggctcttaactcctagcttatcaaaatatttttcaagtcataaatgcaaaaatgatttatcacaggaagagcattaggtccacagcttccagggccctgttgtaatgctaattacacttcaccattctgtacgctaagcctcctgtgacagagcccgggaaataaaaacatgccatacgtacgtatcataaacattcagcagccagttcagacacatatccacgcagagagggacgttgaccaaattgttgtgctcttgctccaggcggtcataaatagtggtcaaacaattaataatctgcaggatatccatgggctggtcattttgcttgaggttgtgctggtccaaggcatcacatgcagctgacaggctcaagagatccactgcaaaaaacaaataaaatcacaaatgactcaaagagtaaaaccttcctttcagtgtcctttttcctctgagaatcctagctaggactctctcataccctttaataaacaccaaacgtgaaccacactctctttgaaaggtgttttatttttatgcctcgactctaagttgatgagtttgatcagtattcaggatctgaagttgttcttaaatctcactggcattgggtgaagatatgggcaaagatataattcccatccttggattactggggaatatctgagagttaaggggacctagcctgttctacataaacagagtcaattgtcacctgaataagaaaaaaaaaatgttttagcagaaatttttaaagagatccgatgatactttcttgtattagcattagagaagatctgttagattaatctgtatggctaaggttgtgtaaactctatttctagctatgcatttataatcattaagcgcttttctccttgaaatatcagtcacctcagcatctctctgctaccctaatattaggtgaaaaaaatactctccactaaaattttctataggcaaactaaagtaattgcataatctatccagttttcagacctgaggctcgcttatttctcctttcaccttcaaattgtatttcataatattctttctaagtcctctaacaactttataaggctgagggaggaaaattcccttgatctgaggaggtgtttaatcttatgctggggacaaaaatttaacaaaagtgaaacttcaaccttgtccaacatcagcaaatcacaagctttattcccaagtgtcatgaaaagatgcatttctctaaagccaatttattagccaaactagaaacacaacaacattgcttttatactaccttatacacctaagctctggttggaattctcagtcctttgaggcaaggaatcaatgctaattaagtaaatctctcatgcatctagggggaaggggcaattcaattataaatgtagttcacataaatagaggtaaatcccgctcagtaaacacctttcccagtaataaagaaatgcaaacttaaggctttagtatattttacaagttattcatggccagttctaattaaatattaagaaaaaaacaaaaatagtggttaatacctatgtaggtttgtgcaaaaatacttttccacctatattgcgcacacatttttctcttttaaaaaaaggaaaacagaaaatcctggagtttccccagaagcatgaaacagacatggtggtggaagcaggagtctgcactcctcccttggaagggaaggcccctctgtttttgctctgaaatactctaaagatagagaaatgacccttttcatggaagctgagactttctttaaagtgggaggaaggaagataacttgggagacttatctgaagaatcaagtgagaaaaataataaagaattttaaaaagcaatgcaaggaggcaggaggacgggaggacgtgaggagggaatggctgaaagaagactgcgtgggaggctggagcgaggtccagagacaaaagactcaaacttttcttctctctctcttctgtgtgcttgttttcctcagagggcacatactcaagtgcacgtagtaggaacacttagaaacacggtatgccagctccattactggaagagaggaatggatttcttccaaacaccaatattcccaacatgtttccttatatactgaaggaagctatgggtggtttgaagtttttcaattattttcttttttgttactctgctttagtcatcataaatattttgcctctgatccaggcatttaagaagtaactagtgaaaatttttcgaatcacttttgtattaagagtcttatttagccgtgtgatggaaatgaacagagaaaaactgcatgcatttcattttatggggcctgctcttatctctgtacaggtgaatgggtaacacatagaacagcaaatgttgagtagaaatagctccagaggggagcaaagcaattgctctgaaattacaggagcagaagatgacacagttaggagagaaatactgtgcagtgtgctctgctaaaactggatgtggttaaacacaagaacaatccatcacagaagactgaagagcacatttccctaaacaaacatgtcaaacagaattcaactttcatggagctattttgaaaaaatttccatttaggtatacacaatccatgctatggacccgaaaaggaggtgagaatatcaatagggacaatttaattgccatgcatatgcttttcaaaatgagcatcttagagaacacacctagactttttgatgaaacattaaatgtaatgattagctctttctaggaccctcaataagcaaccagcagatacagttgtgtgaaaccattgtttccttaagctaggaatttccattaaatatattatatatatatatatatatatgtgtgtgtgtatgtgtgtgtgtgtgtgtgtgtgtttgtgtgtattcactagtagatatatctttaaagctacataaaaacccaagtattctaatacatcttcactttctaaattatgtttacagtagaggatgctataggctttgaagccattgaagaacagggaccatgtggtggtaccctatgcatgagggctgtgggggtgagagagggtggggacaggataaaagaaatggctgactctccaggatcctctttgctgtgcaggaaaagcagacagtggcggttggggggcggcgagcaggcaggacttcaacacagggatcccactaatggttcctgaggctctggttgtgcctaatcatcttctcaaccttctagcttcaaaagctcattcttttcctttctatgtatgccacagtagctaactcttgctattccttcctatgtaagacagattttttttgtcttttacagagtgatagactcttagagccagaaggttgctttaaaatcattttgcagttgagacaactgagaccagagatatggagactcactctgggtgttatggcaggatatctaggttttctgatttctcatggaggtacatattgtaagggggaaaagtgggtggcagaaggtgtccttactgactttacagaacaggaaaaccattctgcattccatgctaatgacaacagtaggataaaacagaagcaccaaaaagttggttagtggagaaaaaaaaagtctcatggtgcccatataaccccaagttcatcctataggtcaatctgtatattctatgttgatgtataaataattctgtgatctaattagcacagaaacagaaagaggtgagtaatggtggaagaactgctgtatgtttgctgatttttcttgcccaggcatgccactctacaggcaacttacacttatggctgagggacctcccaagcaaatctttgcacttcaagaaagtcaatgcactttgatgtagttgtctgtgcagtaagggttaattccagagaggctggagttggcacgagatgacttgctaaaatatctacacagtgcagagccctggtcaaagcacttgcttttcaaagtgacttactgtgttgaagtgtagccatgggttgcaggttatcaccattgtttattgctaacagtaacattgaccatttttacccgggcacagtcagaccaacggaagccactgagtttgaggctggttacataggaacagtatgcctaggttacccacgggatataagaaaccctggctgaaactccaatttgtgctccctggtttccaaggtgttctgtgctcacatcagtagctcttgttccaagagagaaaatgcatcgtggtgtggctcttgcagacagagggcaattatagcttgcacctgtcctctctggaccctatgctgtgaggcaggctgtggctgtgacacttattcttgttttaatgttgtgggtatattgcatcctttttctgcaaggaactctagattcgtaagcactgtcatttggttcctgtgagtcctctttagcaattgaaccctgtttaacttccactgtcagggcagtgagtgtcagaagcaagattgtttagaacacctccaactcattcttagctaaaagtatgactgaggcattatttagaaagaaaaaaagaagattctgataaaagggatgaaaaagaacctttgaagttgctcaacaagctacgcttggttgaaaagtaacacaggctttgaaattggttactgatggtgtaactttctagtggaatctggaagtgagagaacttgaacctaaggagctaacaaaatggattaggaggcaattgcaaactgatggcaaggctgctaaaaaaaaatccaaaagctaatgttaagttcagaatttctttccactgggcttcaccctctctggcctgcaggtggagtcccaaccaaaaagctgaagcaactatcatttttgagaaatgggctacacctgtgagaccagttacaattaaaaagataattcaagtggggcacttacaggtattccctatgtcactacaggtttcttttttgatgccagacctagtagtccctgaactggggctacaattaagagtttcaaaggctggtaatattccaaaataagatactatggctattagttggtacttaagcacaagcattccacaaggatcaatggaatggattactccttccttgtgccttgcctaattgaagctatcacacaaccccatcataggttgaaaatatcttaagtcacaaatgcatttaatacacctaactaactgaaactcacagcttagcctagcctaccttcaatgtgctcccaacacttacatcggcctacagttgggcaaaactgtctagcaacaccttacacagtaaagtgtcagttgtttagcctcatgatcttgtggctgactgggagctgaggttcagtgctgctgcccagcaaggggagagagtatcataccgcatattactagccttggaaaagatcaaaattcaaatctagaagtagagtttctattgaatgcatatcactttgcatcactgtgaaatcaaaaaattgttaagttgaaacttcacaagttggggactgtctgcattgtgtggtgtgtgtgtgtagctggggaagaggtttggcttaaaattaatgataaaaggaaaaaggtgagattgttgcaaggggaaggaaaccaccaaagatacttttttatttcttttttcttttttttttttttttttttttgagaccgagtcttgctctgtcacccaggctggaggacagtggcgcgatctcggctcgctgcaagctccgcctcccaggttcacgccattctcctgcctcagactcccgagtagctgggactacagtcgctcgccatcacgcctggctaattttttgtatttttagtagagatggggtttcaccgtgttagccaggatggcctcgaactcctgacctcgtgatctgcctgcctcggcctcccgaagtgctgggattacaggcgtgagccaccgagcccagccgatacttttttttttttttaaagggaaaacctaatataatgttgctgcctacggagaggtttaaaataagagaataatatgctcccttggcttagactcagatgcctcttggggtgggggactctgctaaaacctcctcctccttgaaagagccaagatgtgagtgggagagtcagccaacctatccaacacactggatgacgagatgggcgttctaactgcgactacaacaccatggagcaatattaatgtggcttttggttagtattcgttaatgtcttttggttcttctttcacaggacatatctgttattaatcagctgtgtcaggaaataacctgagggaatatttacccagtcaaatctgaagaacaatgatttataacaatctcaataaacactgtgtggccatcaattgtgatgatgaaggtttaacaaaggtattgggcatgtgatagaaggcttacgtgctgtatgtttcatctgtcataacattatgtgtttaaaaaaatagctatttgccccattactccgtgtggaaagccattagtgggtggagggacaattgggacagcttgaatcagtgacagatatttaagttgaatttggtgggcctactttcctgagactgaaaagctagaaattggatatggatggctacagaaatttctgtgacatacccaaaccaaagtccttttaggagtgactactattcatatgattttagcctagtcacatttttgtgtctcatgtgtatttcccattaaagctgctatttctcaatggcaacatgtctggtgggccaaggggcatgaatccacttgaaataaaagaaacttctattaggagaattaggaactgggctagagatacctggccaggtagaatttgctttgaatgagaaatgataaactgacgagaaagacttcctagtgcaagaagcgcacttcaagggcatccaattccaggaggaaggatagggatggcaagctgccaaggttgatagctggagaatggaaccaataattactagaaaacggaacctacgaggtgttctttaatctctttagcatctgactgagagaaaaccattctttccctagtgggtaacagctaaacaagattacagtatttcccctgggagatagatgggtcatgttatgagacctctcttgggcactaatatctgtcaaaccatataaactgagaaaattagtttggccatgtcctcaagacgtcttaaactcagaactaacagagacatggcctctaacctatgtgaaaaataatacatggtatatagaaaaagtagatttttgtaggacagtggcaaaataattacactggcctctcgagacccccttgctgtggaggcagcctgtggctgtggatccatatcctgacagtaatgctcttgtaatgtagccttttctggcaatagagcgcggatttgtaagccatgttattgtgggtcctgagagtcttctttagcaactgaagcctatctaatgtcacccttagcgcaccatcaaaaggtgaggtgcatttacagagaaggcggtgcatttttcacctggtttgtcatggtgagggcgagtccagaaactgtgactattcacacaactccagcctgtaccaaatctctataatgtgtgctttagttgctgaatagaggcaaaatgttctctatttcttactgtttgcagaatatttgtcacacttatcaactgcagtatatttagccctatggtttgggctctctccaacccaccacacattattaataaactaaatacacttgctttgttaagtgcgtttttatttctgctcttacaagttggctttttaattttagaagcctcacacctgtagaatgtcatcagaactacaaagggagaaagaaaatgcttaaattaccttcttcataactttcaatggagtatcagctatatgaaacagtttataaatccttcttaccaagattttatctttgttcctgcttttctaccaagtttcattttcatttccaatgtgttgagaggcagtaaggagtcatgcaacacttaactgattacaaactggggacattataggccaacggtgatgctctccacttaaatagtgaattctctatagtggatacaattgggttatttggctttctgcaatacggaaacattgatagggaagtgaaaaaaaaataagatcaagtgcttaatagaggtggaagtgcatatttccaaggcatctgtaattcaaactcttcactggcaccaggaaatcactgagataacatcattaattttccttaaagttagagttggtagaagtggcctttggtagggaaagctagccagggcaagttttatttgcctgtaccgcagacaatagctctttatcatggctttgcaggcttagaaatgacaaaagcctggaagctaaatctaagcaaatataaaattaggagaaaattcttaaatcatatattgaaagtaagtaatgtgaccacacatatgttcaataaaaggatggggtgaactcttcattctatagttttactatatatggcaccctcctagcattaatgagaattcaatacttaatttagatacatacaccttaattttggcatacttgaatctttttcacatattagaaaagccatgctcagaaaggaaatgcagagaatttcaaattgatttaaaagtgaaaatttaaagaaattattctacattcggagcttacctttattacaaggttatcacctcaaatggacaaaattttgtatattatgaaattcccccattttcccaaagtttattggaaattataagttgaaatgacagacaataaaacacatatgtgaatggaattttttttgagcaggaaaatcgaataatgcctaaatccagggtgaaaatggacattatagaaaggaacagtcattataaggtttttccatctggtctatttctgggtttcttttttttttttttccatagtataaactggaacaaatggttagcttctgaacttttaggatctcacaggaatattctctagcacttcatgataaccagtgcctaattactcctttattaaaggaaagcagtagctctgggatggggcaggggcaggggcaggggcaggtgaagaaaaagaggcaagaaaactttctctattcagccccctgactcgatcccatcccaaactactttttcccagctatgacgtattaacaggtcctaaggaaaccctcgacctggaaagccctttaaacaccagttaaacttggcaactatatagctgaaaaatgataacttcgggctataaggaaatggaagccttggtttactttcattcatgcattcatctcatgaaaacatattgaaccatgctgtgtgccaggttttgtactaagcattggggataccaagatgaagggaaaaggcctagtctctctttccaaataattccacttctaaggcatttcttctctatctctgtgtaagaaccatatgccaagtgactccttgactatcttattgctagcctctgcagatcctctggttgaacccctttatttctgaagacctggcagccagggttcacggtccttctcttttgcccagttctcgctccaattctgcatgatttcaacattggcatgggggactcatgcatcattctagcctctcagttccttaacttgctatttcacctccatggaaattcacatccactctacctctgccacctactcaaatggctatatcctagatctaatcacctgaaactgttccaccttcaaaataatgttcatctatgattctctctgaccacaacttcttgaccttcagttcctttactacttcttcccctacctccctgaagagttagcattttcatccctctacctcctaattaccagtttccatatgcgttcacagcttctcctacccaacagggacttgtcagtatcattttaatcaatcttttgcccaaatcctcacttctcttgcccagctgttccctccctaccccaggacagaagcatctggctcccaagtgctaagcgtgcctggggaaataccacacccctgcagattggagctaccgtgaaacactcagccgcctctgggttcacacagctggttttcaactccgccctctctcttattctccacaaagataagcccaacttcatcatctcctgctgttaactgcgttgcagggactctccactccatacaaaaaatggaagcctttatagtaagacatccttcaccttgctgctacctggtttcttagttacctggacctgcccagatccttccctctaccccacccattacagtggaagagaggtatctcttccctcccttgggctctggattacctgcccgtattctctgagaacacccattatttatcatctcctcttgggccaataattgtaatctcaccctgtcttctcatactcatataaatacattcccacgaatactatatgtttggcctgcatttgattgaaaaaaatccacgtaagttgacccaagcagttcaaacccatgttgttcaaggatcaatgtatacacacacacacacacacacacacttatatacacatattgtgccacataatgacatttcagtcaacaatggactgcctatatgacagcgagcccatgagattacactattatatatttttactgtatctttctatgtttaaatacgtttcgatacacaatacttactattgtgttccaactgcctacagtattcagaacagtcacgtgctgtacaggtgtatagcctaggagcaataggctatcccatacagcctaggtgtgtactaggctataccatctaagtttgtgtagtactctcctatattgacataacaacaaagttgcctaacaacacatttcttagaacatatccccattgttaagcaacacgtgactgtacatacatttccattaactcctcagccccctccaactagctaccaccccactcttctccccttcataagtaaatttctccaagaatcattcataccttctctaattctccacttttggttcacttttgaactcaccacaccacttccactgtgcctctaaaatctcaccaaagttactagggaccttcctgttgctaagtccaatgggcattttccgcaactttatgctgacatcccagcaacatctgaccctggtaacgggttctttctttcttcccatggagcatgtggcatcataacctcttggaattttccttctttcctcctggccattcctttgcagtcccttctgtaggttgcttatcctgtgtcctaaataacttcccttctcacgctacactttcctggagctatccaatcctctcccccgttacaagcagcacctacaggctcatgatccctaaacgttgtttgtatatttctcctgagcaccacagctccgtgtctaaccttaccagacaagtcccacattcacctgatattccaagccaagcacctaagtgtcttccttgactccctttcacccaccacatcaagcttgtccaacctgtggcccaggatggctttgaatgaggcccaaatgaattcgtaaactttcctaaaacatttttttttttttttgcgatttttttttttttttttttttttttagctcatcagctaccgttagcgttagtgtattttatgtggggtccaagacaattcttcttccactgtggcccggagaagccaaaagattggacatccctgcaccacatcaaatgaatcactgaggcctgtcaaatccacttcctaaatatttctaaattctctccacttatctcccttactactctgctaattcaagccaccacattgctggtttagattactgcaacaggtttttctcctgtcactcccacatcgcaccaatccatactctgttccacagcaagaatcatctttctaagcgacaatctgattatgtcacccccaggccaaatcccctgacctctaaattccttaacttgggttttaaaaaccttgcacaatctgcttcctgcttctctctccagcctattatttcacaatagatctttcccctggaattctgtgctttagccatactgacatattttcagttcctgaatgtgtcatgctttctctgggcccttcagcacatgctcttctttctgactagaacgctcttcctagagagagagctgcttactcttctagagttacctagcttagacatcacctcttcaaacaaacattctttgaatctcattccacacagttagctgttcacatagtaccccattgtcccactgttgcacaactaaatatatgacattgaaatggtcttggaaatagagacaagatcactttatttttttaaccaactgtagacattcttaatacattatacatatatttgcttatgtctacaaatttcatgaacatcctggttatcccttgttagactgtaagttccatcagagcagaaactgtgcctgttgggccgggcgcattggctcacgcctgtaatcccagcactttgggaggctgaggcgggtgaatcacctgaggtcaggagttcgagaccagcctgaccaacatggtgaaaccccgtctctattaaaaaatacaaaaattaggccgggcgtggtggctcatgcctgtaatcccagcactttgggaggccgaggagggcggatcacaaggtcaggagatcgagaccatcctggctaacacggtgaaaccccgcctctactaaaattacaaaaacaaaattagccaggcgtggtggtgggtgcctgtagtcccagctactccggaggctgagccaggagaatggcgtgaacccgggaggtggagtctgcagtgagcctagaacgcgccactgcactccagccagggtgacagagcgagactctgtctcaaaaaaaaacaaaacaaacaaacaaacaaacaaaaaacaaaaattagccgggcatggtggggcatgcctgtaatcccagctacctgggaggctgacgcaggagaatcacttgaacctgggaggtggaggttgcagtgagcccatattgcgccactccactgcactccagcctgggcaacagagcaagactccatctcaaaaaaaaaaaaaaaaaaaaaaaaacagaaaaaaagaaaaagaaactgtgcctgtttcatgggcatatcatcaatgcacacagaccctcagacaatagtagagttatacataaactatttgatgacatgatagagctgtgtaacacttcaggatttttccacagatgtatgataaaaaaggaggaaagcaattctgtcatttttcctctaccacttcattcatctgcacgttagcattcaagctaataaaccacacatgtctatgaagtttggtttagatcagatagtcatagtcttctaatactaagtacattttgtaaaaagaaaaaaaaacaaaggtagaacaaggattgtgcaagtttcacaaaggtaattatggatgccgatgccaatgccagtagttggaaaataaaaattctcaatatcttaattcaacatcagtagctgaggaatggtgacaggaatgattctaaaaataaaacaaaacattctaggcaaactctaggccaaggatacattaaagaatgaattatacattgcaacaggaattgtgacagctgtttctcccctctctaagtaaaaatgtacccaacctactttttattctaagcaaagacatagtatcaagatcttcaaatactggccaatacttacagcaaagggccttctgcagtcttcggagtttcatggcagtcctataagctgagaatctgacattattcaggtcagctgaaaagagggaaaacaaagagcatttgttattccatcagaaataacagacaacccacccccgacgcccagtgatttgccaataactacaaccaccacaaaaatagcctagaaaacatatagtgtgtatacgccaagctttcggaggtgaaaattctgttaacgtggggaaaagaaaaaataattccttttgccctttgacaaccaggaaggctaagttctgtgaagactaaagtggtatagcctgaagggcattcatgtagtcctgttcccaagaggaaagagatggacaggcattatttttttctagaaagtaatctggatctactgtagtgaatcttttctgcacaagattaaagagaacaagaaatacattatttaaatagctataagaccttaaacaatcaagtggcaatataacattttttctgactgtagaagttatacatgctcactttgggtaacttagacatttaacatatacatatataatcaaataaatcatccacaagcccataaactcaaaaataggcacaactggctggattcagtggctcatgcctgtaatcccaacgctttgagaggccaaggtgggaggactgcttgaggccaggagcttaagaccagcttgggcaacatagtgagatcccatctctacaaaaaaagtttatataaaccttttaaataagcactgttaacattttgagtattttttatccaacatatgtgtctatgtgtgtgatatgtatttaaaaatataattaggaataaaataaacatttggctctatattctaaggtacaatcattctaatgttcagcacagaataacaacaatatatgttactgtggtttctgcagtcaccggtctatcaagccctgactcacgccacctagcaggaagctatatttagatgatgttcttactcaagtctgcacaagccttgatagatactgggctacatttatttcaggaactcagctccaaaaagctccttgaagacaagaactctgtcacctacttctgtcatttttcctagcaacttaatatgcaactgccctctgaaaaagctgttttaatacagatcatggaccgactgaccaactgaatcaataaacaaaagaatgaaagaaagaaaaagtacactgacatacatgactgccataatcaaatgacacctacgaaaccaattctgatgaggtgttaggaaagggcaataattcaatccatatccaagtcacttgggtcaacattttcagctttatggccatcgcagagaccaaacataaaagcctgaatttcaactaggggaaagaaaacaatgtctgtaatttaaactattcagcatacaattttgtttaaaagaccggaataccaaatgttggtgaggatatggagcgactggaattctcagacactgcttgttgggaatgtacgacaactttgggaaaccagttaggcagtttcttatgaaattaaacacacatgtatattatgactcaaatattcttttcctggatatttgcacagaataaaaaaaaatgtatgtccacaaaaagatgtgtacatgaatatccatagcagctttattcataatagtcaaaaaccggaaaccaaccagtaaggtaatggataaacaagttgtggtaaagtcattcagtgggatactactgtgcaaagtgcaataaaaaggaactaactactgataatgcaacaatgtgaactgatctgaaaaacactaagctgggtaaaagaagccaggcacaaaacagtacatactgtttgatttcacttatatcaacttctagaacaggcaaaacttagctactatgccagatggtagcctggggtgtggtgggagtaggtaactgacctcaaaggaacacaagggtgttttctaggtgatcgaaatgttatatcttgattggcatggtggttacacgagtgtatacatttgccaaaatctaacctgaacacttaaaatggaaacatgttatagtgtttaaattatgccctgataaggtaaattttaagagtctttaaaaaccctcacatgaacagtacactctgatgtatgtgtgtgttagcttaagctacactgtagaggtggtcagttgtcttaatcaggagtgaactccaagggtggttggctagcaattaatcaaaaagcctcatgccacaggcggccactgtaagtgattcagttatatttagctcttattacaccaggggtttcattaattttcctaattaatagttagacgggcctgtgtagtgatattagtggtttgcaaaatatgaagattgttgaaaaacatttagaaacactccctgcctttaaattgagtttaagaagaatccagtaggttctccatctttagaaatggtgccctaggctgaattccaaaatgtccagctgtggttcaccggattcttagttgccagaattcagttagatggttgagggaatcctgctgctagaacaatggttttcagacttgagcaaacatcagaatcacctggagtggatagtttaaagatgcagatttcctaggccccacctccagattttctaattcagtaggtatgggaagggcctgggaatctgaatttctagcaagtttccaggtgatgctgatgctgctggtccagggaccacactttgagaaccactctaatagaggactgtggcctgtgtagactgtgagcctctcacaccaagcaccccaaaagacagaactgtgacttcactgtgtctctggcacaggctgtaagattgttttgtacccattggctaataaatgctcctaagtgacagaacttgtactgagacttgctttctttataacctggcagccgagaggtagttaagagggcagtcctcaactacatctaaccatgaatgactaccaacaccaattacagagaacctgtgtgagtccttgttagtcaaagtgtgatttgaggaagaatagcatcagtatctgcttggagcttatgagaaatgcagaatctcaggccccacccagatctgtgaatccgaatcaatattttactaagagcctctggtgattcatatggaagttctttaaatgaatattttaataaagtttcttgttccgtgttgttaaacttcaagtataaattctgtataccaacaccatcctgtgttgtcttttgtttttctatctttctatcttccattttgtgggcttttattaatagattatttaataactactatagtcaactacaccaaaacctcccctctgggatatatttgtgagtctcttgtttatgataaataccaataaaaagtattcaataaattaaaagcatctcggagtatcttgaaatgctatatatacagattgcttcttgaagataattaacatttgcctggacgctgtcctttagtgagcagaacttgatctagttgagtccctttaattgtccttctctctctctcccctaaaagatgtggttcttcctttgtctcttttgcccagtcatcactgcttacttttttaagtggtctcagccaactcatggtatgaattgtcttgcggcatcaatccatgagaaaccaattcctgtcctcccctccagattggtgcaacatccttcaccagtaccatcaaatttttcctgtacttgctagtgtggagttcccttacacacacactcatcattgagtccctttgactctttataaaaagaaatgtagagacgtggaaatgcacttttggtcaaatacagatccctttcccattaacaccagcctgtagcagtttccaggggataagcatccaatcccaaattttctctcattcctttacttatgcaaaagtattgagtgttagttttgtgccagccaaacatcttgtagaagatattggcataaagtttctcttctttttttccctttctaatcctccttctccactgcctcgtaactcatgtgcctagtttcctatcatctttcttctttcaaagaacgacgattcctctcttatgaccccaattctaccctcttttcctattttcctggttctattcagcatttagaacaaatggtctaaatgaggtcacaagctccatccaaatcttagcgttcatatcaagaattggcaaattccagtagctagagatccaagtgggagaggcaagaatgatctgattctttcagggcatgaatattagtgtggaacagtatcagagttcaaactttcttcccttctaaatacttctaactatgacacattctgcctctagttaatcctccctgacatcttttcagcctacccccaacccactgcagtgaataagccttctgctaccagttttccacgcaccaaagtccaatccattctcaaacagtgattcaggcataccagaagaaagtagcagggaatgcctccagctttgttcttttggcttaggactgacttggcaatgcgggctcttttttggttccatatgaactttaaagtagttttttccaattctgtgaagaaagtcattggtagcttgatggggatggcattgaatctgtaaattaccttgggcagtatgaccattttcacgatattgattcttcctacccatgagcatggaatgttcttccatttgtttgtatcctcttttatttccttgagcagtggtttgtagttctccttgaagaggtccttcacattgtggcattattcacaatagcaaagacttggaaccaacccaaatgtccaacaatgatagactggattaagaaaatgtggcacatatacaccatggaatactatgcagccataaaaaaggatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgtggtggggtggggggagtgggggggatagcactgggtgatatacctaatgctagatgacgagttagtgggtgcagcgcaccagcatggcacatgtatacatatgtaactaacctgcacaatgtgcacatgtaccctaaaacttaaagtataataaaaaaaaaataaaaaaataaaaaaaaaaaaaaaagaaagtagcagggcaaacgtttagcttccatcacaatgctacggaagccatacaaatgtatatctggtaactgtcagtgaactgcaacggagttctggtgccctacaagtctactactcaagagagttaactgcctgtgttgtttgagtccgcatgtgttgctaggagtctgcagcaccactccctccggcttacagctggaagagataagtctctgccttaggaaagtgtgtaggatgcacacagaaacctcaagatgcaatacagctgtgaacaatgtgacactgtcctgggctaaagcttgggatgactgtgtagtgaaagtatgtatgcagtttaataaagctaaagccccccattcccgtgccccatgagagactgtcctccactttccctgggagctgactttccaggactctgatccaagttgtaatgagctcactagctctcacagccggaactcaagaggagtgagactatccaagaaaccagttacgccatgtttccatggcagctgggagaaagcgcacttcagaagggtaaaaatgctgaactgcacatttctcttcataacttgtattattttatccagggctggttctagcctataaatagagaaatctagaaacgtaaggaacaagggcaaacatcaaaccacctaccttctcaagttgaatttccaactactgaagtgataggccattcatcttttattttgaaacatgaaacaagtaataggcttctcttgcccctttgtttagtctatgcatttttcttgactttggtaagtatttctgttttatgactttcacttttactctgtgtaatagtagcaggtgtcaaaattcaccagaaaagaggaacaactggtcaagtttgcgtcacatatctacatgttacatgcttttgaaaaatagtgagaaacacctcagcattttaaagccatggaagcattccaaagatattacagaaaaaaaacattaagtcccttcatttcaattttatagctggtttctgtctttttaataatactgcaaaaatcctactatctctgactgaactgaggtctagaatttaaaacaaggagtgttttagtctatctttccaatggcttatggagactttttggaaaggcctaaggtttcaatatgcctatctattagctagaaagaacaataatgacctcattaactttatgagtggaaagagctgtacggctaaatgattattccaacagataaattggtatagtggtctttgtttcttcataccaactctatttcccagaagaaatttaatccaaatctcccaggtggtaagtgaaaaataaaatttagagcacatatgcttttgggggagtattgttctaaattcagtgtttggcatacaatacgcattgaactactactgcctgcctattttactaattttccaaattttcccaagaagccaaaacaaggcagtctccccacatactcctattatagaaaggtggcatattttaaaatataataatatgtctccaattttccagtctcactcctccaaaggattctaatggacttttcagatgacaagtattattcttgccagctcaaactcactagaacagacaagaaccttggatcttaatgagacttcagacaaattgagtaatttaaatccagtctgtcttgaaagcaaattaagccaaaatatccaggcttcagaagtctagaattattgggagatcttcaagaacagaccaggaattctggaacatatctttaaagaattagctgagagaagaggaacactaacacatcatacttggtctataattttttagatatatttgaggcctcttaaaatctcaactcgtaaaaacctcatcatcaacatagagctttacttaaatgggggaaaaataaacctacacacagataaacaggaattatgcattcatacttagataagtacagaaagtacagtctgtgaatttataattactatcaagttatgtttccagatgtgaaatggtattacttatttatcaccaatgactttgtaaaactcttctaagaaatgaaggagagggccaggtgtggtggctcacacctgtaatcccagcacttatggaggtcgaggcgggcggatcacgaggtcaggagttcgagagcagcctggccaacatggtgaaaccccgtctctattaaaaacacaaaaaaattagccaggcatggtggtgcacacctgtaatcctagctactcaggaggctgaagcaggataattgcttgaacccaggaggtggaggttgtagtgagctgagatcgcaccactgcacttcagcctgggcgacagaatgagactccatctcaagaaaaaaaaaaaagggagagaagcaataaagtacctagtatggcacaaatgtggaagactcagaattgaggaaaagagaaaaaggttatgaaccaaaaaatactgagaagttcaactgtgaaataaaagatagcacaaaatcctggctgtggattgtttaaggcatttctggctccctcctcttgcttggccttcctcagcagaatctcactacttcttagcaacactgtaataatggcagagttgaaattcaaattagttttgctcattgttagctgccctggtaaaaggtttgttgagaaagcagtttctgtaacaaatggccgatataaagttttctgggggagaactgtgtatcttaagtaccatttctggggcctgaattctgccccagataatggagggctgactcatataggcaccactgtgccatgctcctttaaatcaagcttcaagagcggaaggatcagggctctaactcccaaaaccttcattatatataaaacatacaatccataataattatggatccataaggataaatgtcttctaaaaagctacaaagcagtgttgcctgatcttttaaaaatcattagtattattttaatatataacatatattattttaaatacatttaaaatagtacaaatgacatatttaaatacatattttatatatttataacatatgtgtatttaaatatgtatttgaagtaatactactgattaaaaaagactctttaggcagaactgttttataactgcttaaaagacattcatctatccataatcctttcatctatcctttcaatatttattgtgcatgtactataagccaagaaccatgccaagtacatggaatacactggtaaccaaaataaatctctgcctttattgactttgcagtgtagcgaaggagatggataataatcaaatattcatatgtaggccaggtgcggtggctcgcgcctgtaatcccagcctttgggaggccaaggcaggcagatcacctgaggtcagaagttcgagaccacctgggccaacatggcgaaaccccgtctctactaaaaatacaaaaaattagctggatgcggcggcaggcacctgtaatcccagctactacctgggaggctgaggcaggagaatcgcttgaacctgggaggtggaggctgcagtgagccgagattgtgccgttgcactccagcctgggcaacaagagcaaaactccgtctcaaacaaactaacaaacaaatattcatatgtactgtggtaaaatggtgaaggaaacacacaggaagtgatgagactgtatacatagggaaacataggtccgagaggcttcttggagaaggtgacattgaagcaaagacttgaaggatgatgggagcgtgccaggtaagaacacagcagcgtaataggtcagcacatgttaaaaaaaaaaaaaaaaaaaaaaaaaagctctgaagcagagaagaaggtggggctttaagaatccttagaaggccaatattgctgaaatctcagagaggaaggaggaagagtgggcacagataaggcctgacaggtaggcagggggaggcccactgcagagccctgcacatcgtgtgaaggattttgggtgttgggacttctagttaaacacagcagatggagcagactcatttgtctctctttatccctgaaactctaccaggttgatagaagaggaataaaaaatggcatttacccaaaagaaaattaacaaaacaggagaggagatgagaacagatcagagctccagtattttggtggcttagaaaatgacctgctggtaaccaacttaggagaccagagaaatcccaagctcaattaatgatgttggggagacaaggagattggggcagggagtgggaggaactaacaagacgcatgccagtttatgtagccaagaagtctcagaaatgaaaggctccaggttcctctgaagactgaaatgtggctgaaaatacaaggactggttgaaagtctttagagccctaaacacctcccccacttggagcctagcatctcagccacctgctgcttcatcctgacagaaggctggaggcttaatctcgaagctgcaccacacaccagggcgcatgaggagcagtgaaatttggaagtgggagaaggcactggaaacagagggattacataccagctctgcatcctgaaagaaagtaaatcttcaaattcatttccttcatttcctactcctcaattccatatttagtctgctgttttctgttaactcattttaaaaagctcttctacctaagcactttcttttttgccacctttatctccagaaggaacttcaacttcagcaaggtatgcagccattaaattgttcctcaattatcatccctatatatcatattcttcatgctgcagttacaactactccaaatcaaatcaatgcactttccttgcagtctccctcttgacaggcgacttacagtcacacaggccactctggctgctggaataaacaatactattctcctcctttggctcagaaccttcagtcactgctctctcctgtttttctcagtcacaacatgggtaactcagctacttacagaactctcagaatgacacaaacttataaatttaccccaatctccttcaactctattctcaacctcattaattaacgaatcttaacagtctctcttcataagtgaacacacatcccagattcgccagggcagagccagtttaattaaattttcctctttgttataaaaggtaagactctaaaaatgatcagatgtgacttaattcttatacctttgcaaagccaaattcacagatttttttttttaatgttgtgccttagcttttttggattgcaaaaacatactcttcataatatggttgacattacctattttgaatttatcactctctcttacagttgaaaaatttgtggaaagcgtattttaatgatgaaaataaataacagtaaatttcctcatctgctttaacctcatcttttgccccttcctgttttaaaaagtcttaacttaattttcctaaaggctaccttttctaccttggccttaccgccgtctcggcttacttatttctctgcccttatctcccaagatttcaacatatgatctttctcccaaaactccatttcaattacttctctggtaaccacagaccagaggtcaccaactggttgaatttagtctgcagactctttttttgtgtgtgtgtgtgtttgattcgttggtcagtttgggctcacataatggtttttgaaattgttgaatgatacgccattagttaaaaatctggtgatttcccgttgtcttgcttctctggaagaacctgaagacctgacaatagagactcacattctcatagaacagtcagctgcaacggaggctctgttaccctaacagaagcttttcaggttgccccagttcccacccagtcaccttcagtcattcaaattaccagcttggccccaggaggcatttcttttcagatctttgcctcagcctgaccactcccttgttctcccaaaagcttttacatttacccttcagttacactctttttcaggtccctgtcaaggctctgactgtggagtccctccaataagtagctattacctggctgtcactcaaattactctatggaaacagttgttactgggttttcccaaaactttccagcgattaattctttggactccaccttttactaatgcattcaaactaaatgattgtgctgccaaaaatattgccttaatacacttactgttgcagtacaagaacaggtaggaagacaggccaaaatccatgagtctcctgactatatttcattaagtgacaattacttctgcatttaaaatcatcagttgacgcttacttaagcacctattatatgcctaactgtgtactaagcccaggggttaaagattcaggtttctaagatattggggaaaacaaaaagattattcaccctgtaaaaaatcagtacacgtatcccaggtatttgtgatgtgtcaagcaacacacacatacaaaactctggttatgtgagtgtcaaagaaaaaccagagatggacggtaaagtggtaaaaacagattttattcaggaatattgcaatagtgggaaagagacctcagtatagaactgggctcaactctgaatacagcatggacaagtgggaattgatagccaaggagcagggtggggtttggtggatggaaaactactaagagaaagcatgggggtaagggggattctagctaaaaaaaacttaacaggaaccttgctgaagacacaggccagggtgatcagacgtcacatgggggatggtggaggatgaggaacctgatcagatacataagaggaaggtggttcttgctaaactgatttagcaggattctcgctacagctggatttttacaaagaagtgcacaggtgggcctaggagaaggttcaggagtctggctgaagtttgatcaagtagacaatctttatcatgaggatgcttatgtacatacagaaacatataatgaaaatagaccatcgtgcagtttatatgtcaaccgcaaaggtagtttccaagatgacataagcagtattccaatgaacatttttaaggttaatggcattggaaatttcctacataagccatgttactcatgaaacagtaatttctaagcccacaaaggcttaaatttagtttaaatatccagtatacaataaaaataaaatctatagtaatactgatagaaatgactgatgtaactaattagaaatagctttatttttcattcttatacttgagggaaaaaagatgagaaaaatgcagacttctgaagaggtcatgttgtgttcacttatccttggcatctagggcaataaatgatggtgctcaataaatgtatttggaataaaattagattctgaaaggaacttccttgcttttaccaggtttaagctgtcgatgacattgattttacatctaatttttcttcaaataatataattttccacttctatggctgaatcactggaattattatttttgcttactccttacaacctgagctggagcttcttttttgaaacacacctcacaaagatatcaagactttcctaaggaataaaggaattgggacaaagagagaaagaaaataaatggtctaaaaagaatgcttatttgcaaggtgaatccgctgtatttaattgtggcagataactgtatgttggctcactcaacaccccttcccaaattctttctccttggtctttctctgctacaaaggctggaggatctcaattccctgatccagccaggggaagctgtgtggacacagttttggccaatgcttgagaagatatctgcaagaaaggatttcccttcccaaatggaaagacaaagagactctgaggctgaacgtcctttctctttcttcctgcctgagaagcagcagtcgtcttggaaccatcaggaccaaagtcactcgttaaaaatggtacagcagaataaaccatggcccaggtctctgatgacatcacggaactcttccatagctctcaactacctgcctccagacttcttgttctacaaaaaatatcaactcctctgtgtttaagatacaattggtcagatattttattaactgcaaccaaaagtcatctctaactgacatgttaattgaactgtaagcaacaaaatgcagaagactaaatagggagcatcgtccacccccgcaatcctccttgcggtggagaaatgacgtgagcactaaagagatcttgggtggcagagatctccatccttgctaccaggtggtgccactgatgcagaacagcttgacagctaatttaacgtttaaaacaattttataacagagggcttatatgggtaaggcactcttctagacaaagtctgcaaagtgtttagccatttgtttggaatgggacgttcacaagtctgattctgcccagatgtaagataaggattggaatttaaaaacatacaagttacttctctggaaattcacgtgtcaacctataaatgaacacatataatcaactagtttttcattaactctttagagttaatgaaatgttcataacttcatctctagtgcaaaatttcctctttatttatagctcttaagataaatgttatttaaaaaaatagttttggtaacttcaactaatcatatgttttgacagtcaaattaagattcttctctaccctttatctaacagtaaacattttaggttctgagtgaaaatgatttgcatcctccatctgcctctttccatttctctggtgcccaacatcaacacacccccaatatccatgccctctaataatcatcatgaataaaatggatgccaaaatgaaccacagtagaaattaaccttagttaccatgggaaaagcaaactgaccttcttgcaaaaaacatttttgcaacatttctgtcttaggctggtatgcatgctttcacctcattaggaaagatacattgtttgggttttgttgatgttgctgtttgagaggtgcaagaagagaatctgttgagtctttatgcatgaataatgagtccaagatagaacacaattcaagatatttaagcatctaggatcatagtaaactatgcgtatctctgctttttgtatactctagcataacagaagaggggaacaggtggtatgactcaaattgcccatgcatgcagaagcatgtgatagagaatgttttcttttcactgttatgtgttaacttttctggagactagatgctaatgatgagatcctgctgaagacactaatatgtaaatcattccttaaacaaaattacttagcagctgcagttatgataaaataaatcaatggtaggagattttcattagataatggactgcctggccctctgacatagactgaggtgcttttaataaaggatgcctgaagcgttcctgtttaccctctgtgtatctggacaatacatttgaatctggaaccaatattaccggtactccgggaaaatactctttttattttatttttattttttttagacggagtctcattctctcgcccaggctggaatgcagtggcatgatctcggctcactgcaacctctgcctcctgggttcaagtgatgcttgtgcctcagcctcccaagtagctggtattacaggtgcccaccaccacgcccagctaattttcatatttttagtagagatgaggtttcaccatgctggccaggctggtctcgaactcccgacctcaagtgatctgcctgccttggcctcccaaagtgctgagattacaggcgtgaactattgtgcccagccttgaaaagactcttctttatcacctcaaaactatgctgcatttgggagttgcttgatataaagctttaccaatttgaagattcaatccaagaatcgggcagactctgagttcctctgcccacctcatggatggccctgaagtcacaggagtgagtttgccttctttctcctctcagtggcaatgaccacggattccttgtcttttggattgcctcctacttcatagcagacagggctcattccccctttctctgcctctctgtttctctcacttctcacctcagctttcttttcaacacactggatctgacccagcttttattctcctcagaatcctggacaaaactacttgaggataaacctaaagcagcccttttttcctaagatgtaggtgactcttacttcagctctttttgtatgcaagtattccctgtagagccaaagagaaaaacggaagtgacaggccgatggcagaaggaatactaacattcgctgagcactcaagggcaaatgtcgtgtgtacctgataccatcgagtccttacaaggccctgagttctgtattatcagctttgttaaagataaaatgaggctcacaaatgtttggtaacttccctacggttgcatcccagagcctgcattcaagaccaaatctttctgacactcaaagcctctgatggccttccccgcttctccgctacagaacaaatgtctttccttacccagtgtaatcctaattagcacaagggtgaatgggcagtagtaccctcagaagaaccatgataccgggcaaggagcagagggtatggggtgaggcagaaacccttgcacaaggaccacagggagggaaactgaccagtcaatgggatgagggagtgaccaggaatgtaactagaccaataatgatgaagttcccagtcctccttatctagagaagtttgctgaataatcaacacctgcagtacgagtttctaccatttttcctacaaaagttttttgctcccatagaaacatacagctgctttctatttacatggtgcagtatatcaggcactctgagggttaactaagattctgtgacttagggacctaaccaccatttataacacatttcattccaaattgtatgcaactgacttacaaataaacttggaacagagcccgagggtaagtttggaaaggcctaaatcttgtctcaaggtgggaatgtggttcttgcctgactgctgagaaatttaatggttactgggcaaccaggaattaaataatttgggaaattttaactctacctttttcttatgagtattctttaggggaatatatatactttttattaagaaaatgaaatacatggtgccttagaaatagaatctctaatttaaaattttcattttccaaatgagagaactaaggactagaaagctcttagtaacttgttctgaattccctagtcagctaggagaaaaacatcaactagaatccaagtctttttctccccaagtgtgtatcccttccctgagcaagccacagaacaaaaatataaaggctcattctaagtgggacttcaagtctactcattcagcttaagggctcccaattgctcccaattcgaacagagggcccgtgaatttctttaaccttgacaaacatctgactggaaaacaaattttcccaaaagcaagcagggtctaattttcccctgttaagagtggtttctagaccttggcatcttcttaaatttttaagattcagctcctcctaacccgctctgacatataaagtcatagtgttgtgaagcagactgtgttatagaaggaagtcaggaagtaaggatgtgaacatttcttttaaagagtagcagcagcctccatcctgaatgaagaagccaggtctcagacactcccttagacgtgccgcctttaagaaaggacatcctctctgtacttctgatgatcagcttaatttcccatttgaataatgatttttttgtttgcttctgaagtcatgagaagcagttagcatttatgaagctttgaatggttgtccaatttgacttaaaggccacgagatgctgatgttaaacttcgtacatttatttctgggttcctgtcttattaaaacactgacataactctccatagtgcaagttttcattcaccatctgtcagtctattgcgctacaggaaaaaaaaaactccaggttaattatgtaaaaggtaatagcatcaaagaacagaacattgtgcctattatactctcaatgtgcaaaaatgggcatatttttatgtgtatgtttgtatatgcaaaaatatttacagaagcaaacataaaaactatactgttaattgtctctaggaagtaaaattaggggattgataccaagagtggttggagacttacttttcaatactatcctcttacaatgtttgatttcttaaagtcatgtgcactttttttaatgattgagtattaaatctatctatcttcttttcaagatttctctatctgggatttcttccaaattcttagcttcacccgctgtccttcaggagagtactattgtacaatggaaaaactactgggtagagaagaaaacttaatgggctctatttatgtctttgctgtaaaataatagtaataatggttatcatttattaggtgcttaccctatgtttgcaataaataacataaattctcaggttatcatttattaggtgcttaccctatgtttgcaataaataacataaattctcatataattaccttcaactgtgatatcattatttcaatcccattttataaataaggaaaccaaaggcctaagaagtaaaattcaaatccatttgaccctaaagcccttcctcttcatcactatggtctcccaataagcttggtctagtaaccttaactttcctaagcttcattttttttttgttcatttttaaagggaacagtaatagtacctattcctagggctgttgcaaaactaagagagatagtgtatctcaaaagctccaaagaggagatgtatcttggatatatacttgctcagtaaaagttaggaacctttctctgcccctgtacttcttgttataaagtataataaaagtgcaagtaatatttttatcatgctgtggaccaaactctttcttcggttccccttttcaaatggctttagagtatttcctcttcaaaatgccactgtcccctctcaggaagaaagtatagctgaggggctaaatcgctggtttaggagttaaaagtacacgtaaatccctgctttgcaatgtgagaaaattacctattttctctgagcctcatctgcacaatggagatacaaatatcttttacagggtttttgaaaggattaatgagaaatatatgcttatggtatggcagcacatacatttatatgagccaccaaaaataaatttttctaagaagagaaattgtaaataaacccataagtatgtaattcaatcaaattcatatctattccctgttgctccgctcagtttgcaatttcctcttttcctcaatggtatcaccattctctgtgtcaccacgccttcaaattttgaagacatataactccctttttctttaaaacctgtccaatctgtgattaccttctggcaattctaccttgttaagaaaaacctctggagtcacgttcccttttccttcccccattgctatcctaagaccctcatcatgtcaattacctcaaaacaaaacgaaataatctctcccctctctaactgtccttaaactcacccaccaaattcctattccaaaacacagaagacggacttcattatttctcttttctgaagatttaacaatgtttttcccattgccaatcaaatgcaatgtaaatttctcactctataatttaaggcacttagttcaccccaggggcactgaatcagatttcccttttaaaaatctggagtggccaggcgcggtggctcattcttgtaatcccagcactttaggaagccgagatgggcagatggcttgagctcaagagttgagaacagcctggataacatggcaaaaccctgtctctaccaaaaatacaaaaattagccaggtatggcggtgtgtgcctgtagtcccagctgcctggggggctgaggcaggagaatcacttgagcccaggaggttgtggcaccagtgagccatgttcgcaccactgcaccccagcctgggcgacaaagtgagaccctgtctcaaaaagcaaaaaaaaaaaaaaaaaaaaaaaaaaaaatctggagtagattctcagagaacaatgtcttcactgactcgcaaacaagccagtctttcatacctttgtttatgctgctacactatctggaatatcttggccctacattttactttacctgagtattacaaaatttcttcctagaacaatgtttttttccactctccaaacaactctccctaattattctaattaatactgctcttcctacctatataaggtaccatacgtttgaccttaatcttatttaagttggtgtacacggtcttgtaacatttattaactgttttattacttcccaattttatttcccccaaaacacagtaacatcttttgtgaagctgacataggcttttttcaaaggatttcttatacaacaggtagaaagatagcaggcaacaataagatatgtgtgtgtgtgtgtgtgtgtgtgtgtgtgtgtgtcatatataaatttgaatgtataagccttcagtcattccaacctaagacatctaaagtaaccttgaaaagcaaaatgggtatacgttggcattaataaacgataccactagcaataagagaagataaaataatatggttgtcatttgggttctacagacagaaaggacttagaataatgtaagtgttccaccaccggccacaagtagacctggtaccatctccttcactctcataggcaaggaattctatcacatcatgaagtccgctgcatgaccagagtcacgccagcttgggcaatgaacagggatcatgccttatacttttgtgcattctattacccagagaaaggttttgaacattctaagtactccatatttatgggggaaaaaaatcaatgcctcacagaaaactgtaaatgtaaactgaccatatctatggtatacatgagtcttcctcacccaagaggcaggaagcaatcttccttttctgttaataactgaatagccttttattaggacagccactgtaatttagggctctgcatatatttaaaaaatgtgaagaaacaggagttggtatagagaataaaatttaatttaatgggtagataatagatccactaaggatggataaagggataaggcttatttagctgaaaaaaaattaaactgtacagtatttatgtaaccaggaggctgttaccaactagagcccctcaacataacacacaaaaaagtgtgtattatatcagaaaagtttggaagagttgtgtttggttaacttcgttttgttttcacattactcaaaaaagaagaaaaacacccagcagatatttaaaagaaaacatttgtggtcactagaaataaaaaatacacaaatattaacaatgagatggtttaattttccttgttacaatagcaaaagtaaaaataatactccatgctgggaaggacatggttagattggcactttgaagtattatgagtgtaaatggctacagccttttgagaaagtttcaggcagtgcattccaagaagcttagaaacattaacaccatttgactcagtgattccacttacatgaatcaaatgtagaaaggtgttatgcataaaggtgttcctcaaagtcttacgtggaacagtagaaaaattggaaacgactatggaaataattatcagctctatattctttaattgcgtcttggccagaaaatgtaactgaagtaagaggctacaaaagccttaactgacagttagaagcaagaaccttgaaaagaacatgggaactgtacacacaaatgttttgagaagataaaacagtctgctagccattctacctggagagataagttaaaggtaactaaatatttacatatcagttattataaaaattaaaacttacagaaacccatcataaagttgagtttctgtataaaattgcttgctaagaagggcaaagttgttcctgtaattcggaaagtttacaaggatacttgccttgtcaccttgacaccatacatatttggtaaagaaaattttatccattaagatatttgtggtagaaaactattgatttaaattcatagctatatttttcataggataaatgttacttatcaactttctgataactgactgtctgtttttgaccacactgactttattctgtaacatcacttatacataagtagcttgttggacagaaggtattataacactttacttggctttcttctcagaagcttgttagtaataagcctccagattcttaaagatttccttccataaattcaacacgaatttgacttttctttgtcacaattttcaaaaattgggaaatatttttttacaaaagtggtaccccaataaactgcaactagcgaaaaataacatctctgaggaactaagaataagagaagacttatgattacagtaggatacaacactttaaacattctattatctcaaacaactatataaaaatgcataggaaagaagaccggaagcaatcttttaaaatgtaaatagtggctatttctgggtactgagatgtgaggtgattttcattttgtttttgcacttcaccttctaaaatttctagaatgaacatccatgttttaatgttcaataaaagtaagatcataaaaacttctataccctcagtaaacgtttttctccttgatatttttagcctgttgccctaaagtttgaaaatacatggcacgctcttaaatgtttactgaagcaggaaaccaatgaacgaacgaggccatcagcacatcaaattgtgttcagtgtttcctttctttgtcatataaattctgaatccatagtgacactttttacgggtcttatttctccttatcaattaattattccttttagggcaaaattaattccagaatagcagttcacttggttttgctaagataacaaattgccaataaaatctacaacttaactgatattccctattttaattactttgaggctttatcttctactttctggaaagaactccatctctccagagttccatcttgccagtttaataatccgccttagaaaaccctcatctgtatctttccatcttcttgagtggtatttgttttcctcccgagcaaaatcactctcccttgctctactgtgcttcattcaatgaacaattattttttcagaggctaccatgcaccaggcactggtgacaaagatgaggaagacagttcctgctttaaagaggctcattacaggctcatctcattaaattgcactttgctgtattgcactttgtgaaaattgcattgtttacaaactgaaggtttgtggcaatcctgtgttgagcatgtctatggacatttttccagcagcatgtgctcactttgggtctgtgtctcgttttgaaaattccctcaatatttcaaatttgtcattatttttatatctattatggtgaatcgtgatcagtaatcgttgatgttactactgaaattgttttggggtgcaactaaccacacccacataagatggcaaacttaattgatcaacgtcatacgtgttctgactgctccaccgaccagctgttcccccatctctttccctctcctctggccttcctgttctgagacacaacaatattaaaatcagggtaattaataaccctacaatggcctctaagtgttcaagggaagaaagagccatacctctgtcactttacatcagaagctattaatgattgagcttagtgaggaaagcatgttgaaagatgagacagactgaaagctaggcctctcatgccaaacagtcaagttgtgaatgcaaaggaaaagttaatgaaggaaattaaaagtactaccctgcgagcacacaaatgataagaaagtaaaacagccttattcctgatatggagaaagtttgagtgctctgaatagaagatcaaactagccacaacatttctttaagccaaagcctaatccagagcaaaaccttaactcccttcaattctatgaaggctaaaagagatgaggaagctgcagaagaaaagttggaagctagtagaggttgcttcaagaagcttaaggaaacaagccatatccataacattaaggtgcaagatgaagcagcaagcattgatgcagaagctgcagccaagttttccagatgaagctaaggtcatggatgaaggtggctacaacgaacaacagattttcaacatagatgaaacagccttctatttaaaggtgatactatctaggactttcatagctctagaggagaaatcaatgactgccttcaaagcttcaatggacaggctgtatctcttagtagggcctaatgcagctggtgactaagttgaagccaatgctcatctaccattctgaaatcacagggcccttaagaattatgtgaaatcaggccgggcacagtggctcatgcctgtaatcccagcactttgggaggctgaggcgggcagatcacgaggtcaggagttggagaccagcctggccaacatggtgaaaccccgtctccactaaaaatacaaaaattaaccaggtgtggtggcagacgcctgtaatcccagctactcaggaggctgaggcaggagaattgcttgaacccgggaggtggaggttgcagtgagccaagatcgtaccactgcactccagcctgggtgacagagcaagactccgtcttggaaggaaaaaaaaaaaaggaattatgtgaaatctactttgcctgtgctgtataaatggaaaaacaaagcttggatgacagcgtatctgtttacggcatggtttactgaatatttcaagctcactgtaagacctagtgttcaaaataggtttcctttcaaaatataactgctcactgacaatgcaccttgtcacccaaaagcttggatggagatgtacaaagagattcacgttttcatgcccgcttacacaacatccattctgtagcccaaggattaagaaaaaattgtgactttcaactcttattagttgagaaatattttgtaaggctatagcttgacatagacagtgattcctctgatggatctgggcaaagtaaatggaaaatctctggaagtcaggtgtggtggctcacggctgtaatcccagcactttgggaggccgaggcaggtggatcatgaggtcaggagtttgagaccagcctggccaaaatggtgaaaccccgtctctactaaaaatacaaaaattagccgggcgtagtggcacacgcctgtagtcccagctactcgggaagctgaggcagaagaatcacttgaacccaggaaggcagaggttgcagtgagcctagatcacgccactgcactccagcctggacaacatagcaagactgtgtctcaaaaaaaaaaaaaaaaaaaatctctggaagtgattcttgatgccattaagaacatttgtgattgataggaggtcgtcaaaatatcaacattaccaggagtttggaagacgttgattccaaccctcatggatgactgtcaggggttcaagacttcagtggaggatgtaactgcagatgtagtggaaacaggaagaaaattgaaatcacaagtggggcgtgaagatatggctgaattgctgcaatttcatgatcaaactttaatggatagggagttgctacttatggatgagcaaagtaagtggtttcatgagatagtatcacattctacagagaaatctttcacaaaaggaagagtcaactgagtggcagtcttcattgttgtcttattttaagaaattgccacagccaccccaaccttcagcaaccaccatgctgtgcagccatcaacatcgaggcaagaccctccaccagcaaaaggatcattactggctgaaggctcaggtgatcgttagcttttttaacaataaagtattttaaattaaggtatgtacattgttttttaagacataatgctgttgcacacttactagactacattatagagtaaacataacttatatgtactagaaaaccaaaacacttgtgtgacttactttattgtgatatttgctttactgaagtgttctggaactgaacctgcaaaatctccaaggtatgtctgtatttagtcttgagagtcatgagcataaacacctgtaaacgtcgcaagtactttcatcaaatgcatggaagcttatccttagtgtttggacttctctgcagataatttgttttaattgctacctcctctcctttaagatcagtttcctttgaacccaggatgtccttctggtatcttatctatgtcacctcaaactcctatgaaagctttttagtttttttatgtttcttgttcccgaaatatctgcatagagggttggttgccttactgtccatgggatctcctgtacttcaatcatttgcttgttggtttttgatactttctctgccttttctctgctctgctgtttattacagtacattttcctgctcccttaccaattggcttccaagtaagtttggccaataggagtcactggcagaagcctagagggcaggcggaaaggagaagccgggcgtacttcctttttcattctacctccggcaataggtctggctaactgtgtctccttcctggctccagctccctcggagcccctccctcattggtcccagctggccaaaggttccaactccgccttgatgcccatgacatctggggctctggtgataccacctcttgtcattgtccctccagccctaggtataacagaaacttcatgctgtgtgtgtggcttctcagcacttccattcttgagtaaccaatttcccgcattaaattccctttgtttgaaataactagagggtttatgttttctgaccaggcagaccctgattgatacatcttccaaatcaaaaaccttagtataaaaaaccttcaacataccatataaggcttttcacagttttagccctcctcatctctacagccattctgtgatacctccactaccacagactagtaccaccatcatttattagatatttatgctcttttttgagacagagtctcactctgttgcccaggctgaagtgcagtggtgcgatcttggctcactgcaacccgtgcctcccaggttcaagcaattctcctgcctcagcttcccgagtatctggtactacaggcagacgccaccacttctggcttttttaaatttttattttagtagagatggggtttcaccgtgttgcccaggctggtctcgaactcctgacctcaggtgatccacctgcctcggcctcccaaagtgtagtcttttttatcctgaatgatatattattttagaattgggggagggcaaacaacacagtacaaaatgtattattttaatttgcatgtcaaattaaagtacgtgtatgctttccaaaagttaggataaattgtgatcaggtgatctttatcaccttggttaagaagtaaaatacttcagaaaaatttagtggctccttgagtgtcaaatgtgaagacctaaacctaggtgtctctcactatctgaattcttggtatctcaattcaggaacccaatagattattaaataaggagagacactggtatatgataataataactaataataataatgcatatcactaatagcaattataattccttgagcagttactacatcagacattctgttaccttacatatgtcattctaatcctcacaacacaagataagtctcatcataactatttaatacatcacataactgaggtttaaaattattagtggcttcctttttgaccacagagaactggtgacagaatcagaatttaaatccagcctcaaagtcaatgaacaattttgttgctgcaaaacattgcctccaaacctaaactcataaagtgacaataggaaagtcacagtataatcaattagttcccccactgaatgcaccccataaagagtgcatatatcacagtttatattctagataaaagcaaacctgtattttaaacttatcacattatatacattatatttaattatagggggtgcgagagacattaaactaggcagcagtggctctgccgcttaatctctggttccttcctgtaacacaatgatttctatgctttgtcttctaaaacaattgctaaggagagctaccaagtgggaaagaaaatagatccctcctctgcctgaacttgactcaactggcaaaacattaaaccgcataaataacattttcaggtgttcctgtttggttaattatcctcccccgacctgagtcacttgatttgagtttacatttatactttcaaaaattaagtgctctagaacagtgctactcaaaatatggtctttcacaagcatagatatggacagtgtgttaagtaacttctatagcaatttgacattgccatgacatccaaattcatgatcaatgaattcatctcatggagcagggtacagacgaggtcaagtgttgttgaacttgactgttgagttacatgtggtgtgaatgcatacttgtcagtttcattagcaccacctaaaaatctgtgatgtgtagtatgttaaaaaccaccaccgcggctgggtgcagtggttcacgcctgtaatcccagcagtttgggaggcggaggctggcagatcatgaggtcaagagatcgagaccatcctagccaacatggtgaaaccccgtctctactaaaaatgcaaaaattagctgggtgtggtggtgcacacctgtaatcccagctactcgggaggctgaggcaggaaaatcgcttgaacccgggaggcagagtttgcagtgagctaaaatcgcaccactgcactccagcctggcaacagagcaagactctgtctcaaaaaaacaaaaaaaaaaacccaccaccaacaaaaacctggcccttcaccagtttgagaagcactgctcttcagtgatagcttctttttttttttttctaagacaacgtcttgctatattgcccaggctggactcaaattcctgggctcaagggatccttctgcctcagcctctggaagcgctgggactacaggtgcgtgccaccatgcctggccttaaagtgatagcctctttacagaccaagaaagtaaaatataaaaacaatcactttcttaccaaaattaatgcttggtaaagaaatctgtatgtaaatatatcaatataagcaacatttgtctccgttatataagcttctatttatgagggggtgtaatgactttcctggagttatgcaagcgatgaacgctttgtggaatagcaaattttgaaacattcccacagaatatcaccaattcataaataagctaatgattcatccactatgtcataagagagactttcagaatatttttaggtcattttattactaccgtagagggtacagactttaaaaactatctattttatgtgagtgctctgactgttctgaatctctttccagcaaaattgcagctcccaagagacatacagaggtaatcagacttgtgggcttaaaaaagaaatattggaaatgtctgaataagagcagacacgtttttagatgcctttactctgtgtgcaaaaatcatcttctgcagatccagctacataaaattgtacatatccagcacttttcttctagctgcaggtgtaaccttaatgttcctcttatttagatcagtaaactacaatttggcagctcttttaaaactgtaaaccagtcaaagtctaaggaacaattctttttgagtttccttctgaaataagcttggagagatgcaattcagaaatatctattatgttcttcaattagaagctttaaatcaagttatttgaacaagaaaaaatattataatatttagaacagtccattaaaatgccataaattttgatttggaagttacatttctattttacaaatggggaaagtcaatggatcctaatcaaagttaaaagagcagattatttttcttttttcttttataagctgaatagtaaaggaagaacatttataacagccttaataacaaatttgagtaaatctcctgtgctaattttgtcagctagggaataaagaatgtcatatggattccagtttaattatgccgataaagcagttttataaatcatgctaagagtaatggatgttcctttgagaacagagaactcggagtttgtaaaatgtgtgttctggacttggttccttatcttctaccatagtgagtataaatcaaatcaagtcttgagtctcagtctgctcaagtccaaatggaaagaagggaaaagttgccccatccaccggtatggtagcattatttcccaaatcaaaaactggaaggacactcaaagggatgacaggacaaaaaatctgaaactgaaattgatagaaaatccaggtcatatgccacctactctatagctgtgtgaggattaaatatggttatttctgaaaactcttcgccattgtaaagtgctacacaaataaagtacaattattacaaatatgattataggctaggagcggtggctcacgcctgtaatctcagcactctgggaggccgaggcgggtggatcatgaggtcaagagatcgagaccatcctggccaacatggtgaaaccccgtctctactaaaaatacaaaaattagctgagcatggtggcgggaggctgctgaggcaggagaatcgcttgaacgcgggcggtggaggttgcagtgagatgagatcgtgcaactgcactccagcctggcgacagagtgagactccgtctcaaaaaaaaaaaattaaattaataaatatgattatcctattattcatatcctttaggttggtggtgacaaagaggaactgggggtttagggctgacaacattcatacaaccaagctttactctagccaggggttaaaacaaaaccagtcatttaatgatgaaagatcactggccaacatgacatataagaaaatgaagaccaatagaaagcaagggacttgcccgaggtcacaccaaagctggcatctgaatctagctatcctttccagttcaaagcgttatggcagtaaaaagtcaaaaggcagaggttttaacactgagcaatatattaaggaactagaagcaagagccaaggaaagctaaatattgagtagcttagtggagaacagtttagttcacaaaatatgctgagaaaagcattaggacaagctcctaatgcaaaaggaaggaattcatagtcattcagaatcctgcagtttctaacccaagagcatcctcaggagggaatacttaatggaatgtagaaagcctatcaaaagaggagagtgaacaaataactacaatatcccttcctcttgggcaagctgaggaaagaggtacaaggattttgatagcagtgtttttaactctcttgcaaattgctgatttataatgatattgatgtatctttaaaaagcttttagccccattgacttaactaggacttaactagttctcctaactagaactgctgaagaatcacacccctaacctcaggcccagcagaccctaaaattaaaccctcattttaacattctgaagctctctgcaaaccatagacatgaagctaagggctacgtgctgatagactgccttcaaatcttatggtttttaaagaccacttttcctaagaattccaaaaacactcagaagtccatttttgaaaattgagagctttcgcatcattcaggtgagcatcatgctggatagtaggatccaaaaattgggcaacagattaaaaagggctagatccttctgaagaacgctataacttaagaaaaggaaaaccagtaccccttgagaaaacacttgtggttaagagggcttcaatgaaggaaaaggaaattggaataagtaacaccagaacatacggtgcatctagattttaataaactgcttgaaataaaatcagctttctgaagtgcagcgattctctcttcacattatcctatttttacctacatgtctccttcataaactggtcttcttgtactatactgacagtatcacaaatgcaaaaaaactcacattgtaatttaaaaaggaaccattggggaaccacatattttattgtatttataattaagagacccccccccaataagacaggctaagaaataatgtttttaaacagggtctcgttctgttgcccaggctggagtgcagtgatgtaacctcggctcactgcagtctcgtcctcccgggctcaagcgaccctcccacctcagcctcctgagtatctgggactacaggcacatgccaccatgctcggctaatttttgtattttttgtagagatggggagacggggtttcaccacgttgcccaggctggtcttgaactcctgagctcaagtgagctgctcgcctcggcctccaaaagtgctaggattacaaatgtgagccactgtgcccagcctaaattctactctgttggtcagtatatctgtccatatgtaaatactcttgattacttaaatttgtagtaagatttgacattggaaattgtgaaggccaggtgcagtggctcacccttgggatctcagagctgtgggaggccaaggtgggaggatcgcttgagcccaagagtttgagaccaggctgggcaacatggtaagacctccatctctacaaaaaatttaaaaaaagattagccagacacggtggcacacggctatagtcccagctacttggaaggctgaggtgggagggtcacttgagcctgggtgttcaaagctgcagtgagccatgatcaggccactgcactccagtctatgtgacagagcaagatgctgtcaaaaaaaaaaaaaaaaaccccaataaaagtatctctaagcagcatatattatgtgtgtgggggcagggtgagctttttaaaaaatattttcttaaaatttcagtaatgaacttagggacctagacataaattgtgagaaaaggacaggcttttaaccacataattgcacttcatgtaaatcaatattatattagtatttcaaaataaattccagagcatattactatctaacatctactgatgttgtaaatgctttctggagccttgaagagctcagagttttaaatcaccaagctaacctattggaacagtctttccattacatttgtaaaaatgctaatagaaatctaaaactcacctcatgaatcaaacatattattacttctagggagtgacgaagaatgtaccctctcaataacaaatgaatgacccagaggagtctaatgggaaatatctcaagagcctctctatttgacaacagcttgcctcactcagcctgtaagacacggatgggtggcataatcttctcctgttgtttgttttctcagaatgtacattttaaaacataggaatgattacatttttagaaatccacttgtctgcagagttagccgaaaggtacctcttgaaaaataatgatcacagcaagtttagaaacagcctgccccaccctcagcccaaagtaaaagaaaaacaaaaatcttagacacttgtccaatatcgttactttttttttttttttttttttttgagatggagtttcactcttgttgcccaggagggagtgctacagcgtgatctcagctcattgcaacctccgactcctgggttcaagtgattcttcagcctcggcctcttgagtagctgggattacaggcatgtgccaccacacctggctaattttttgtttttttagtaaagatggggtttcaccatgttagccaggaaggtcttgatctcctgactcaggtgatccgcccacctcgacctcccaaagtgctgggattacaggcgtgagccaccgtgcccagccccaatatcctcacattttaaagataaagcaccaaggtctacaaaaaatagacatgagacacttggtctcttatatcccacttactccactactattctctactaccattctatgactattgggggtagtcacagacaaatgctgaaagaaaactgatttccagttgcttttagtgatttattccctgtgaaaatccaagacaatgcttttgtcaaaccattaatgtgatgtaaaaaattttctggggactcaaattcctaatgactgttcagtcatcatagtgaacctttaaattatttctttactatgtcttgctttgtttgtgtaggactctggcaatattttctctcaattttttgtgtaggtacacagccgataaatgagggaaacacaatatttctaacacttgatggaaacctcctctgcaaagccattttagatctgttggaaataatctaaaattaattatcttatattgttttttatctattttttaatcaaaaaagttctattttctctaccactaaaatgtctacatctgcatttttcacaactggacatacagactaaaaatacatgagatgatctctttgagtttaaagttacctgacaaagtccatgagaatcagggtccttaagtataaattatctacatatatgtggggcgtgtgtgtgtgtgtgtgtgtgtgtgtgtgtggctactgctgcttttctgtcataagttctcattagttaatgaattgtagctatagagacactaagtaagaaatggaatgggggtatcgacgaagaaacttttttaccaaacatctaactgtaaataatataaattcattgtagaaaatcagtggaaaaggaatgaaaaagaaaaccacccagaatgtattagagagctccaatggtaatatctcaagcaatattatagcttttcatcagtaaatacttgctactttttcagttctaacaaaatgttttcaccttctaatcctattgtgttcaaaccctgggtgcaggggaacacctgaatgcttttgagggcaaggcaggtaacataaacatgtgttgaacaggctgcttgggaactttggcaaattagagaatggaaatctccttagaagtgggcgtctctaggaatgtgtaacctaccatgcatactgtgaaccactgtagcttccacggtagagtatgcctggagtgggggtacagagggaaaaagcaacatcttgatattttcagcacctcaccagagacatgaggttcaggttcgattaggagagggggctagatgtggtcttaaacatttgacacgccagaccacaacaccatttctgctttcaagatacctttcaccaactgactgtagttgaaggcttccgaccatttcatccagctcaaagagcaatttggacctaaagggatacctcttgaagaagaaaaatataaactaataagtaaaaactaaaatcaatgaaaagtttcttttcagtattttatgcttatgtttcgactctgaaacactgtaattttggagagggggaaaggcagtgctggtagttaatcttatatgggatctcaaggatgtaggcaggctgggcgctgtggcttacgcttgtaatcctaacaatttgggaggccaaggtgggaggatcacctgaggtcaggagttcgagaccagcctagccaacatggcaaaaccccgtccctagtaaaaatacaaaaattagctgggtatggtggcgggtgcctagtaatcccagctactcgggaggctgaagcaggagaatcacttcatcctggggaggcggaggttgccgtgagccaagatcgtgccactgcattccagcctgggtgacagagtgagaatctgtctcaaaaaacaaacaaacaaaaaaggatgtagccatataacaatcattctatatgtgccaggcaacagtgaaaggagtgcccattgtttaggacccaccataccatttccagaaataccactcaagtaacttactattcataggtaaaactatcaattcctatatacgtgtagcaggtatgtagtaaccaacataaatatactttacctagtaaataaaatcaatgagaacagtgaaagtactaacagaaaactgaggacaaatccaggtgtagccccacatagctgtgtagccctgatcaattcctccctgagcctggcttcgctgtcctgtgaaatgtggatgttgataccatccaccatgcaggttggttgctggcacatcccatgtggaaaacatacaataggcccgcaataaatgggagatgttatctgatgaatcaccacttggataaaagcccaacgaatgtttgattgttacaaaactattggaaatattaactctgaaaggtgaaaagcaaacttcaacacttagttcacttgcaagtggtttgttattgggctagcaagaaacagaatttcaaagggggctggaattgatcacacacttacgatgacttccttttattatataaaaattatacctgaaagttgatttcataaaagagaaagtttgcaataaatgagttctaaaatcccctgcaactgtaaaattctgttataattcaaaattgagtgatgtcacaagcccaatgtcacaagtcatgagagattatcagttttgagtttatcaccacatctaaagtatggagaaaattttagaaatataatgattaaatgtatatttaatttgtattaaaggagcaaacatgtattcattgatagtccataattagcttttcatcaaacatgtttgcaatttctcattacagagtaattgaaagtggtagagaatactatacaacaaaatggaaatatggccatggtaatacattactttccagtggaaaaaaaaaaagcaagttataagacagaatgattcaacttctataaaaatatatgtatagaaagacatttttgaagatcctagactattaaacaccagctaactctaagaagtggggttacgaatgatttgtctcttctttattgttagcctgtctatatttttaaacttcaaaaatatgaataggtattaattctataataataatgattttaaaataagagtgaattaaaatattacaactagaaattactgtaattagagtaggaaatgttagaagtgggctaaatctgtgtaaaccacaggttacgatcaggaggcccacagactaatttaaattagctctttgtggacagatttctagtttttctcttgtacaatcaggggtcctgggagtactgggatagaaagaccagcttgcccaggacagctgctgcccacttcagatgaagccttttcattctctcatttgccaaaagataagcattcacgttttccacctgtggtataaacagtccacaattataagccaaaaacattctgtaggggctggaaatgtagcacttgaaaattagctgatcccaattttatttaaaattttaaacgtttacacacttataaccagactgaaatgacataatattactcgaaatgtattggatctctctggctagtataagtgactttgtttttcctttttcatgttttttatttacatttttcaggttttctagaagacatttaatcatttataattagaaaaatgtttaataaaaccattttttggctaatatctcttctctagtccttggtgtctctatagctgcaattcattttgtgagaatctatgacacaaaagcagtaatagctacgtaccccctgacacacacacaccccacttacgtatacctacacagaatttatgtttaagtaccctgattcccacagtgttcatcacataaccttaaatccaaagagatcgccttatgtgtttttctatcaatatgtccattcacagaaatgcaggcttgaaaaagtagaaaagacatgacgtttttatattaaaaaaatacataaaaacacagcctgggcaacatagtgagacccatctctacaaaaataaataaaaataaattttaaaaatgagctgggtgtggtggtgcattcctgttgtcccagctactcaggaggctgaggcagaagaaccgccatgagcccaggggttcgaggctgcaataagctataaccgcaccactgcactccagcctgggagacagagcaagaccctgtcccaaaacaaaacccaaaacaagctgcaacttaagataactcatttcagaatattccttgtagatctaaaacgacaaaccagacatctggacatttgtccagtgtaaaaagactggtgttttcaaacccttatttgtatgctctgtacccattcaaaataattcaagttatgaggggaaagaaaacagaactgtcaggctcttacataaacacaaaacaagccatactaaagaaatcatttaaatgttcacattaatgacccgccaggccttaggaattgtgagcaccggaaagacggcagaaaattcctttacacaacatttgtggtttggcaaaagggttgtcttggtttcacacggaagaaatcaacaagcacctgaaacagttttctatcttcgtgggaagaaaaaaaaaaatagccataaattgcaactgtttttccatcattttaggcaccaaagagaactacaaagacctataggccctctcaggtatattgaatttttaggaatcaatcaacttctaaaacttgtttttaaggaacctctgataaaaagaaagctgactgtcaattttggataggaaggtgccactgctttcacccttgaaacaatctagtgatgtatttatatagcaagtaactttcacactgcaaactactttatcctaaaggtcacctgtcatttaacttggaggaaacatggccatgtccttacctaaagactggtagagctctgtcattttgggatggtcccagcaagttgtttgagtctcgtggctaaaacacaaaacataaagaaagactttagcatttacaatgagtagtcaagaaaacaggaaaaaagaaaacaacaataacaacaacatgatttttgcttttgaaccattcggaatctttatttcaaagcgcttccatagtgtattgaagaaatgtttatcttacaagcagaaaggcccctttctgctttgtttccaaagagaaaagcaatataaacattattcggttccagaatttgtttcttctttgcacccacaaatcgatcgcacttcagttatgataaattgaccttgttatgtgatcaataatcgactatcaggacttcttcacccatccaatgtggaacactacagaaaggacaccgacaactgattattattcaactctgtcaaagagataccggacattagttcaataaatataaatcatctcacttctcatttgctttcactgcccctgacatttttccattactctttcctctacatatacagatctcatatccatgatacctgtatttcatttcagcttaaggtatatctactgcctgactaatatatcataacttccttcttcccattatttcagagtgttttttctttaaacgcagtacgctatacaccactacacctcttcctatatttacttgggcctgaatgaagcattcacagctgtcttccatttcttgaagtgtggttgctggctatcagctcctgccacaaaaagaacaaaacacctttgttcctcattcaattacatgaataaaccctggagaaataactacatatacttttccttactttggcccatctacataaatcaccatagcgtcatatttccagttttcagggattgcatgacaggctttgatacagtaaaatgcagttctgaatgatatttgggtactcatatgcagagcctattcataaacttttgaggggaaggggagggaaggaaaaaagagaaatcgcttaaactggggcatttccagaggaccagaaagtacaggggcctcacacagaaagaggagtctggagaggcaacaatgtcgaatggccttagcgtatgttttgaattttagggctctgcgccctactggcggtgaaatttaaagcaagcctgcctaccttggagggttaaaggattagttgaaataggtaagtgaccggcaccatttggtgctcaatatgtggtcgcttttggtatcatgtgcccctcaaattgtcatctattaaaagcaaatctgttattagttgattacaatatagatgtggatccaactgtaattaagtcaatcaaggcgaagaaagacccttcctagagagcaaaaccaacacactacatgttatcacctatgtttaaaaaaaataagttaaaacaaccgtttaagttggtttaagaaatggaacacaatcataaacctcataaagacatatggaaatcatccaaactgtacaacttcaaagaccatccctgtaatatttactagtcagtgattgaacagtgagggctactgaaatcaatttgcaagaaaatgttcacttgtgaagtgctgtttcactgtcttccaaatacgtttatttcagttttacttttccatagagacaactcacatttgaggactataacaagggcttatcagttgagggaatataacagagtgacattcaagtcttaaagagcaagaagagcaggagatatggtctctatgctttaaggggttttaggacaccccatgaccaagccggtttatgatctggagaaggggtaggcaggactggtactttacatgcacagcacaaggaggctgcagcttgcagcttcgtggaaaaagtgttgcttgttctcaggcatttctcagctcggaaagtgagtgtataccaattccatatataagtgcagagcaaggaaaggttaccttctattgagaccaccctgcattcaggcctcctctatttccaaaggtcatccagatgtgatataagcaccagggagaaaggaagagcgaagagaggaagcacacacatgtgtgcccacatgtacaagggctcacacaggcccttactagtcacactgtgtaacaacaatgtcccatctccaggatatttgtaaggaccgtagcatcttctataggtctgcagaaaaacatttagctgagctgataagcctgatcagacagagacagggaaccacggtgaaaagccaccatctggaatggacttcaaattagaggaacataggcaagaaataaacctgtaccaaacacagttctaaaaggaaagggaaacagtgtgtacaatttacaggagaatcccacatagaatgaatgagggcttcatggagctccccatcttctaaagaaatttcatgactgttggcatacatacattcctgcctttttaaagaatttattttgaaggttaaaattatgaaaagggttttagaaattatttttttttaatccatcagtcctcggcaaaactgaaaatctcctttactggaagaaggaggaaattctaagcccccaattccattgcccatttgtgagttaagatactagtccttgataggtactattctcccagttatctgtgattctgggggacttgaataacatagataaatgaactcctcaaacaattccagaagctaacctttctcaccttcaacacacaaaccttttatttctaagcaatgcaaaagaactagaaaaacagatttagatttcacctttgcagtcttagtttcacttcaattgcaaatcagttctaagcaaaagaagtgagcacaagtggaaagaagaaaagaataaagggtgtgactaattcttaaaacgagaaaaatagtcttttaatcatttaatgctaaaaatgcttggcaacgtagccaaaaaaccttcagattctttggtaactatatgacgaaccaaatattcacttcacggcttgttattttctacctgtgatgaatccagagccccactgggacacatttaaccctccaaaatagataggaactatgaatatggactggatgaaactgtaagcacaaatctgcataactcatatctatcttgtaccttgaaggacaaaccacatttttgtctgtgatcaataccgattttacagcttcgtttcttactctgtgcctgccttctaaaacagtagagaattctcagtaactccatgagaagagcccacatttacctggaatatgcagacgatatagaaaaacacggtgtgctagggaggagggagtggaagggtgggtggcactgttttggtaattgtctcttttctgcatttcactctccacatcggaaatacactccccatataccatgaacaaccaaaagggaaattctgaaacctgttcacatgttaatgggtacatctttgtttggcctttctgagaacaacaatgttcaacatagatcacaagtctgtacgtacattaacacagagatcagcttcataaataatccttaaaacgctctttacatctttaaaaaatgttattgattttggccctgctggttccaaagcctggcatcagatatgcctctctgagcagtatttatacgaagatttcccctctccttcttctttctacaaaccatgataatctttttcccttttatttgaggcggtgataggaccctgatgcaaattaaaatataaagtcatcgactatgacaaaagaccccagcaacacctacttgtcaataataagaaattaaagcattactctactgagcacaaggctgacctaatttcctaccatacaatttaaattttctctcacctgctttagtttcaagtagtgtgcaaggttattataactgcctcagagctgttcctgctgtcagtgctggaataatcagacttattggaattgcttttttagtttcttaaaaacaaacattaaacacttataaaaagtaacaaatatctactgctgtggctgggaaaatggcagttgcctaattaaaataagatttcttctgccaccattgttatttggtactgaaaatattccaaacagttgcctttttaaaaaactatctgtccactacttcccagggagaaaactaatcgctatgcagcaatataaaaagggagcgttctcttgcgatttgcagaggattagagtttggtttcatatataatctggagcccattgatccacacacacaaatgatttccctttaatctgaggatcagactctttttctagaggaaccttggcatttgcgtgctgaattgttgaacttggcttgcattgctggaatactggcagggtgtggatggtaaaatatattttaaagtttctgctaccgtggggcaggggtttggaggggtgggcatcaatataagcatcagaaatccattctagttccccatttcttgttccctgggatatttaccattttattctgtctggctaaagccagggcaaagatgattgcctcggtggctgttccagctgttagttgtcctccgttttatttgcttttcaaggtttaactcctacccaccctcaactttggtcaaagcaatttcttttcagggtcgtgtccaatcggagatcaaacaatgatgactgaaaccaattccacggtgttcaagggtcagagacctttcatataaccgtgttgcttcatttgctccactcgcttctccaacagcaaatgtatcctccaaagaggggcttgagtaaaaggcaataaaaaagctaggcaaaaaaagaaaggttgattgggggtgtggggggggggggggtgggtgacaaggagagatgacagggataaagcagaagaccaagaagagtttattgcccaaggaaaaatgtagatttcacttaaagacgccacttaaaagttcaccacttaaatcggatggatttttttcatgatgtaaaaacagtttataattaatattatgcctccctcgagcaactaaaccccttcaatttaaagcttcaaacttaacttcaaatttgactaatataagcaaagtgttctgccctttttattgccgtgctgggattgggagtgacaaactttgcttgaagatgagcacagacacctggagaaatgcgagagaacaccctagaaatgactccacacccaatcccgaagggcaaaaaaaaaaaaaaaaaaaaaaaagcccaaacaaacaaaaatccccaccccctgaaatctttgacttctgggctttagttgtttgttctttctttcctgatttctgcaggtcttggggcatggaatgagcacggtagaaaatgcagcgagggaaatgtcagttggaatcctcggaagaaatcaggcagaaagttgaccttttggcacttgcagtgcaatggaaggtagcgccgcgtgcgccccttccttctacgagtaagagcgacgatttaggaacagccagccttgctcacgtccacactggcagcctggaaaggagtgaaaagctcccccggccccaatccccgcgtgaggaacgcgttatcccctctggggacggggagaaatcagctttttctctccgagcccgtcccaaagccgagggaagaggttcccccactagcccggcgcctggggagaaaccccgggggcgcacctgcagccgcgccgcgggaacccgcgggagaggttcctagacgcccagccgcccggcgccccgggtccagccgccgcgcctgtccaagttttgaccgcctcagcttgccccctgctcgcgccacaagtgcacggattgcggccatcagacggggccggggccgcgatccacttaccctttgagctgttccctcatggctgcaagggctccgcggtcgagtgtgggtacgagtggaggagtgagcttcccagagccgccgggctccccgaaagtggagcgccgccgccgccgccgcccaagctcacagctgaaagcactgcggaggagccggcgcgggcgggccggggagggggcgctgcgggcagacggggcggggccgtgtcgggctccgcccccacctagggacctgggaacccggacacccagagactgggcagttggggctttcaaaacggaaaggaaaaagaaaagagaaagaaagaaagaaagaaagaaagaaagaggatggggatttaaggtagacccaggaacctggaagccacacaccgctctgctaacacctccttaaagcctctagcaagactacttgttgtctaaataaatgacccaggtgcaaatgacctcatcccagataattaagagtgtgggcttggagttttctttttaaaaaataaaagaaaaaaattatatacataattctcactctcccttcctcctcagttgaagattaaagtggccggcgataaggacgtgaaattgccgttaggctcatcctgggctaaaagggattgttaaaaagactttggatttggatttgtgacatagcagcggatctcaaaatgtagaccctgggaacagcagttatcagtatcacctgcgaacttcttagaaatgaaaattccctgggcccggcccagacctattgaaccagaaactctgagcatactaatgtttgagaatcactggtatggactctctaaattaagacaataccaccagtgctgttgcacggtttggtcctttagtattcttttaggaagatctagaaggaacttgtttctaatagaatattttattggaaaagttacagggcctgaacagttcaaataattctaattttagagtttgcagtatgatgatagaagttaactacacacaattatttcaagcttggaaatactcaaaagaagaagaaagccttcattagcacaagaattttctgcaaacttcacataacaccttagattagcatccaaagagcatcttacgataaactgttagtgatattttcactgcccttctttgtccatttattttgttggcttgcttttctttttattttctttcaaacatttgctttccactctcctttccgattgattcattccacttcggtctacagtttaaatgtggtcccctttttaaaatttatttcttaagggatgggggtctcactgtgttgcccaggctggtctcccaactcctgggctcaagcaatcctcccacttcagcctccaagtgcctgcgatgacaggtgcatgccaccatatccggcttcttttgaaataatccttttctgctcaacatttttccccctagaatgttttaggtggaagcacacccgttttgctttatctaatgctatagcatggcaaaagaggcaaaaataaagtatctggacaaaagcaaaagggaatgccaggattctttattacctttaacaaaccaaatataaaggtaaatgttatcactaaagatatgtgcatgtaagtatgatcggtattgctatttttaagcaaatatggcacttcttctggcattctggctcatacactgagattacttagtgttgccctttagcaattttaagctagtgagttgtggaggcagctgctattacggtctgaggggggcacactaagatttgctttggctgaagttgtcccttggtctaatagtatattctaggtctgctccgatccttggggaagagggattagtgtcctgtaatgaggaagtagtgccctttgcagtaaatcagagacaccaatctctgtgtcagtgtggcaaatcacttaactactgtttatgtttatttcaacgaaaagacagaagcctcagagcatggacatttgtaaatattacaaatcgataaactaaggatttgtaacacctggatagtaagacatttgtcactctcttcctttcctgttttttgtttgtttgttttacacttttaaattacctgctcaaaattcaggagttctgacacgcttctctataaatgcttaagtctcttttctcagtgtccaattagaaaactactaagaataatctgttgacaagaaaaaagaatggaataagaaatcactattcagactttttaaaaaaattgacagatggcaatcctcaaaaatacatctttaagttcttttttagactggagttataggcacttgaagacttgttcccaaatcttgacgtcatattataattaaatactgaaagtattaagaaatgacgcgggcatcacagagactgttttgttgttcaattgcagtcagattatgaattttgcttattagaggaaagcatttggaaaagaacataattgatataccttcgtgtcatatgtaaattatgtagtgatgccatgtatgataatatattgtttgtttatagtagatgtttcttcttctcctccttctgattatattattattattattattactgttttgatatgaaccacggacatgaaaagagcctgaagctctgctaccagaacaaacttcagctaaaattttgacttcagaatcagccatgacctacttgttcccagtaccactgtctagaatggtgcaaggattggaattggggaatccagctcgaagactcatgcgcttagctattctgctatgctgccatgaagagacatggcttcttttcctgtgagaaaggtctgtgttttttctagtatactcatagacaatctcactgatggctcagagcagagaagagtaaatttgctagaaatagagataaagaagaaatgaaatgggatgaggtcaaagaaggcgacccagtacattttcccgtagccaaaactctggtctttgaaccacttaaactttgagggtatctttagagaataagggcatctctgacctaagggactgtgcaggatgcttccccattctcccatccatctctattctttgtccttctccattctgctctgtggcccaggaggttggacctctgtggggacatcaatcaggctttcctgccgtttggcttccttttgctttcagccaattgggaggcagtgatgaaaggcctacagaaggagaggaaaggacaggaggaaggtgatgtttgggtatttattcttcaggttccctcctactgatctctggcctggcagctgctgagttccttgacctgcagccacaagtcttgttggccagtcctttcctacagcaatagcattccaccagttacgcaaaccattcctccctttatccctttgggcaaaagtttaccattccttgtttttttttttttctcctagcctgcctagagccttgtaaatagccttttcattatactctcttcaagtgttccgtttgaatgtaccatctgtttctcccaggaccctgaccaaactgagacccatccagccaaagccaccctctggggcaatagacttgatgctgagtggggactactgatagaggagaaagtcagatccccccactctggggctaaaaagcagatgagactcagtcattggataaatattcagagaagcctcctctgtaggcccacaaagagcttctggccttttgagggtaaaggcatatcaacaattatgatggtgacaacagcagatgtgagggtaaaaaggatgcaaccagcttgttctttacaagagcttcaacggtctgcttgatcttttggagagaatgtcaagataagggttagagaaatgggcaaactggaaagggcttagtgtgacaatctggagtttgacttgtatcctgaaaggtatgagggagctttttaaggaagaaagaattaaagcatgagtgtggctctgtccggtttgtcttttagaaaaatcactcaggcaatggtatgggggcttgatcagaagacaagagtctgaaattcagacatcaggtacaaggagattgcagtatgaggaggatctgaattacagcagtggcagaggaggtggagaaatgatacaataaggttccaactacaggagtcttgactgactggatgtatgaatggaagagagggaagaagtaaagcaatagtcctcaagcttggccgccctttggaatcactcagggattgttaataaatttagatgtttgggtctcaccaccctgagattctaatttaattggtcttggacattaggatttctaagactctccaagtgattctaatatgcagtgaaggttaaggaccattgtccttgagtgacaacaaagattggatgagtagcattctccgagctaggaatttcaggaggagggggcagaagagggttaggaaagagatgatgaatccagtcttgaacataatgaattggaggtggtgatgtaaaagtgcaggtatccaagagacagttggacatctgagtcttgagctcagagggaagatgtctgaattggagctatggatttgcagtgtactgttggaagggtcttgggttcgaatgagcccatctagtggaggctgtgaagggccaacagctgaaactaggctgttcctaccttccacaaacacatctttttcctttctgggttgcatgtggtttcaatgttggcctgatgctagctgtgtaaaaatgcagagtggcataggaaaggacaaagacaaggaatggtttgaactgggtacttgcctggagggatggtcccgagagacttcaccaactcctagggttcagcttctctctatctatagtgcgccctaagttttagtataacctgcatcactttataaaaattcatttagagtataggtatcacttcaattaactcgaatacatattctatagtaaaatgtcagcatttgggtatacaataaagacataagaattccatattcctctttgcatagtacaagtactaaccatgaacagtgactcagacatctaacaaatgggttggtgtatggtgaatcattgctggttagggcaaatattatagcatactaattgaaatatatatataacaatccccctagatcaatctgaaaccaacatcttctggatgtaagaatatccagccaggtcacattaaccagcaaatgaagaggcctctaagttcagacacagagcacttcacacccacacaaaagcctatttttccaggccctgtctctttagggaggcagagtaagccagactcaggaaagttctctgtgagccagctgccatctaaaccagagatttcaccagacaggttccagataaagtcgagctctgcttcactctcacacagttttcttttaataagatttctcaaagcttcacagagccacctatatcaagccgaacatctaaaaagatgtgaattttagcatcttcactaaaataaagccatacttcattaacctcacaggccgacggttgcttcatgggaaagaatttggagtacctattagcctgccagctatagcgataacccatgtatatgacccacaccacctcctgctaaaaatggatcactggttaatgtggttcaagtatatctgactacagcattcctggtctaccttaacagctcaaacttgtaactatttgtctgcctttccccaccgattgtgccaaataagcggaatttcaaaactgggcagaaattcttacactctgcataatctctcttcctcttcagctacaaataaggctttgtattcgattagactcacagcaggtgaaaaccccaattagtgaattcattctgaggcctctaccttcctcccacacaacacatttttgtaaaaaaatcagggaagtctgcgtctcttctcaaatcagaagtaaattaaccctttgatctacccaagcaaactatttactgcatgaagacttttcactgcaaaatgggaggatgttgaaagattcctccttcttgactccataagggaggttacagaaaattctattttatcagactttattgttttcttcaaatccataaatactcacattttctgatcaatctagaaattacagtttttctttctacctgacactcacaatgctaatattatctaacaaaagattaatggacagtctactacaagagagaattaatttttagttatgttcttattttggtgtatttgaggtgagaaaaaaaattaaattttagtttaaacagtatgctttggccttaggaaaggcacagagtctatatttcatactttgtaaatatttatttgtcaaagaaaattcatcattggacaaggatagatgtttggttgaacattaaaaaaaatcaacgcagctttagttcttagagtgatttactcatactttgtcaattgcttctctggaaacaattcacaacctagttttatttatgaacatatgattaaaaaacagcagctttgtcttttttaattgttttagtcctgtcacttttcttgaaacaagtcgtaggacttacccacaagaaaatactgagcatatatcaagtagtaatgcagcttttagaagtagtcatctgttactgtcagaggttcatttcattttgagtctttttaattaaaatgcaaagttctacatacatgcctgcctaaattacccctttctgaaatactcaaatttcaaaaaaaaattttaaatgctaatgtaaccattgttaatactctagacttgcttcttgagatttggaaaaaagtaaacaaaggaattaccagtcaattaagcgaacaaggaagtcatcctaagttgaaacagataaggaaaatgtaataatcaaatgctacagatgaagacaccagcgtttttctttttttttttcctgagatgaatatctacaagaatcacgctttatcaaaagcagcttccttaatcttcagcaagcgtagctgtgtattatagcaaaggcatgaagatagaggggcagagtgtccagaccaattctaccccttagaggtgggtcacttaaccctttacaggcaagtcacttaaccacttggaagcttttgttaactcatctatagaatgtggataatactgccatattgtgggtcaaaatgacacaacggctctgacagcaatttgaaggctggggaatgctgtgttcatgcaaagcagcctgtcaggcaggtatgatttcttaaaagagaactcagtatgttcaggaatagttaggtatacagaaccaaataaattcactttaacattctgttttagattgtcgtgtgagggaaaatgagaggtctgagtttagtaaactgctcttctgtaaactgctctttagcagtttacaaaaggcacctttcctctttttgctttttacacttaagaaggaagcaagtaggaaaagtaagattttttttgtgtgtgtgcaagataaggcactagctgtagcctgagataggcataaaattcacagcgtttgctatcattcagtggggccgagattaaaatatgaatagtattcacgcatgttaaaaggtatatccatgttcatattctcagacagcagaaacctggagtagtcagagagcaagtgaatattgatttggtgggggacagtgagggagaaatatcccctagcttgatggagaaagtctcctggtggcaagccttgaacagccagcaagtggcaggaattccacacaaagacagggatccataaaaggggaaataagataaaatccagtttaaccaattaatgatctaccaatgtctgaatcttgtactccagctctggcttacttttgtcaaggcatgttttcaagatgaaaggaaaatacagatgcaaggaacttttatttatccacaaatttccaagaatgttttttatgtgctctatctagactaagtttctctattaaatattatcctatattaagttctttaaataacttcaaacatagtgtatttatggaacacttacatatgtatttgcttatcatttaaactcttctcattttttctttatggttggtaaaaactggggagtgtttggagaatgacatggaaatatataaaaatttcaacattgtaatccagtttttttttaagtgggatcccaaggaaatatggccttttccttaaggagcttatgatctaatgagagaagatagacccatatatagctaaacacagtatcagacagattataataattacagaaatagagagaaaaaaagcagcaaaaagggaaaggtgattagtttggcctcttgggattagagaatatgcacttcaattaaaaactaagtaggctttaatcacctagttagttcttaaatcaggttttgtgtgtgtgtgtgtgtgtgtgtgtgtgtgtgtgtgtgtgtgttctttttgctagaatatgaagagttgaaacaagtttcttacattgactctgtgagctaatcgctcatattaataatttactaaggtacagagtttttatgttaatatacagctgtgttacgacatcagtttaggctttttaggaattcaaaaatgtatttggccaatattggatttgatatcttgggaaggctaactggcagaaaatactactttccccattaggacatcaaagcacattattgagttaatatgaacaagaccttcacgtgggaattgaagtcctcacagcttgacctactctcatcccttagaaacaggtcgacaaagaattggaagcctctttgcatatgatggatagagaagaaaaaattggcaccacctgtacttttgaatatctttctttttaaaatagaattaaatttgaggtgggaagaaacaagggtggaaaagagggtagggatcagaatggaaatgtatgccaagtagatgatgacaacagcccagttaagagtggatgaaagtctgaactaagaaaggagcactgggaatttgtggagaggctgaattcatgacaggttatagaataaaatcaatgctacttttgagccaattgaatgtgagggctagaggaaaaggaaaagtgtaggatttttgataatggccctattagctgtgcattcatggattcatatttgtgtatatactatgtacatatttatactgtgcattgttctgtaaaggctttagggcaacttataacaatgtataactcttaaaaattaataaaacccagcactaaggaaatataaatagcataaaactttaagaagcgaggaaaatttagaacacagatttgttttttgttttttgttttgagacggagtctcactctgtcacccaggtcggagagcagtggcacgatctcggctcactgcaaactctgcctcccagcttcaagcaattctcgtgcctcagcctcccaagtagctgggattacaggtgcctgccaccacgcccggctaatttttttgtatttttggtagagacggggtttcaccatgttggccgggctggtgtcgaactcctgacctctagtgatcagcccaccttggcctcccaaagtgtagggattacaggtgtgagccaccatgcccagccagaacacagctttgaagatcacagtgcatgatgtggttatgaaaattttgctatgcatacccaccagaatgagcaagacaaacaacacagggttagaaaggatgtggagcaactacaactctcatgctctgttagtaggagtgcaaactggtacaaccacattggaaaactgtttggaagaatgtacagaagctgaacacacacagaccctataacccagaaattctaccccttgatatagtcctcaaaggaatgcatacatatattcatcaaatggcatgtcttagaatgtttataacatcatttttttctaccaaatgcccatccacagtagagtatataatatactgcaggatattgacacaatgggatattacatagcaattagaatgaacaatccaccacttcatacaacagcatggatgaatccaggtttaaagaagtcagacacaaaagagtacatgctgtgcaatttcatttatataaaggacaagaacaggccagaatatttaatggtgttcaaaatcaagattgtggttacccttggaggacaggtaactatcagaagggcacacaaagggccttctaaaggttggtaatgttctgtttctttatttggatgctggttaaatgagtgtgttcagattgtgaaaattcactgaactgtataagtttaagccattttttctttttttttaattgacaaataaaaattgtatatctttatcatgtataacatgttttgaaatatgtatacactgtggaatggctaaaccaagctaagtaacatatgcattacctcatatacttatcatttcttatggtgataatacttaaatctactctcttagcaattttcaagactatactagattttcattacctatagtcaccatggtgtacaatagagctcttgaacttattcctcctaaccgaagtttcatatcctttaaccagcatctcccttattttctacatgcctaatatatttcagtaaaaaagtgttttaaaaggtgggtataatttggttgtggcctttgtagatgtcaaagcaaaagaaaaaatataaaaggaaatatgatcgattttattatttggattattgataaggaggaaagagtgtaagtgaaacaaaggaaaatccaagtctggaatgacttagattgaataaacagatctgcatgggatctaaggtgggagacactgcatggtgtcgactttcagaaaaatcccttcagcagttttcagtgcccctcgacataagccaggaacatgatgccgaggtacacctgagttgaggcaatcttatgggggccaaggcaaagtggtctaagaatgcagctttctgatgacctggcctgaggtggagataaaactaactacagtgtttttcaaactgcaggtcatgaacccttagtacgtcatgaaatctatatagtggatcattaccagtattgttcttaatgaaacagaaaagaatagaaaatatgacagtgtagaggttggagtggggaaaatgggttataaaactacctattgggtactatgctcacaatctgggtaacaggtcatgagccccacaccttagcatcatgcaatgttcccatgtaacaaacctgtacatgtacctcctgtatctaaaatagaagttgaaattaaaaaaaaaaaaaaaatatgaaagtgtactatttggtatgggtaagtaatgttttgtgaaacttttctttcaatcatacaagcatgaatagacagaaaaagatttacagatatagatgcgtgtgtgcgtgtgtgtgtgtaccaggatgacatataaaattaatttttatagtggattggcaaaaaagatgaaagctacaggctttactacataaagaaatggacaaactatacatgcccactggacaatcatgcatcattataatttctctagactaggatttggaaagaagttgacggaagacagtttgcagtcttattccctggtaagggctggaacattacaagagactggaggaggattaaaagattcaggagggggagcaagttggggaggcgttcatcaagtctgaagttctaaccacatgagatgctgcaggggctgagaatctgctccaagttttagggggtgtcttctctgccagctgttcgtttgggtggctgtttgggagtataccaggaatcactcagcctttttgttttcttccaaatggcatggtgatattgtcacattgcaggaggaaaaacattgctgctaaaagtattgttaaggggagtaacaggtagctcacactactatacacaactgcacgttgcctgtctgaacaaaacacttcaaaacataaactgagaaatgcccttctgcttccatcttgcagtgagacctaattcaaagtccttgctagtgtgctcaggtccacgccaacaaattggcaagtgtgtgcctgacagaatggtcacattttagggctggatggtccccattctatttaatgcttataaattcatcctattaagtgcttggggaaattaatctgaataagtgtccatgaagactgataattatcatgatttttaaaagtattctcatataattgtaggaacattttagacagtctgcagccatgggggtattaagcatattatgagtaaaaataacagctttaagaataaaattcctttcaaaagagtgaccagctttgaaagttaccagaaggaaacccacaatctttcttttttcagtatttaatcacagcagctttcattaaattcccagtactaataagtggttaactatgtttgtaatcagtatttcttatatttttaaaagcactagattatggatgctgtatgtctaccattggctgtgaagccacaaacagtttagcctagcaatgattactcacaaagcatgaattttaacagcacactccattttacctacatctaaattcagaagagaatttagtccacagaggaaccttcctgtaacttttcttgaatattttgtgatatcttgcaacatggccaaaagttctagccctctccttggtgtccagctcttgcagtgtgcctttgtatctcttcccaccaacaggtggagtctttccccactccttacatctgggatggccctatgacatgacttgcttcggctaatggacactaccaaacatgacacaagcagaaacctgagaagtttccatgtgaactagcctgaactagcatgttggatgatgagatacacacaaacctagttgcatctgttcctagatgacagcctgtcaaccatcagacatatgagtcaggtcacgatagcttatccagctgccagctgactacagatgcataagcatgcctggcaaacagtagtacaactggtcacaccacataaatggcccaatccacccatcaaatagtgagctaagtaaatggctggccattgtgttatagagtttatgaactattgttcaaatttggtctatggcctgcttctgtacagcctctcagctaagtatgactacatttttagagttgtaaaaagaaaaagaatgtgcaacaaagatgcaaagtgctccacaaagcctatagtgtttactatgttgtcctttacagaaaatgtttgctgacctcagtgttaagccagtaagttttggggttggtctgttatacagcaaaagtagctgttacacatctgctcccaagaaagaacgttagaaactaggcctttctcacaaattcagttagcacctagtcaatttatccttggtgcatgtcctccagttgcttgttaataagataatgctgaaatgaacagaaagaacaaatacacatataacctgggaagttattttagtaatatgcttctcaaaagtaagattttataaggggtatttagaaaaacaagtatacaatttttagcagtcttattcataatatcctcaagctggaaacaaaatcattatgctgaatataagagaccagatacatacaaaaatactgtatgattctatttatagaaaattcttgaaaatgcaaagtaatacacagtgagagaaagacgatcagtggttgcctagaatcaggggtgaaaggaaaaatgacctgcaaaggggcacaaggaggcttttgggggagtaagaacgttctgtcatttgactgcagtggtggtttcacaagtacacatctgccaaaaatcgctgaaccactttaaatggaggcagtttactgtgtgtaaatttttatttaataaagtttattttaaaatttttttaaaaaagcgtttgccctaaaatcaaatttaacattcaaaaatgcatacaactgcacaaagaatgaggtgcatcacacaggatgtttacataaatataggacagattcaggtcatgctgtcagttcccttctgattaattccgaaaatatcaaaacattagattcacaagtgaccttaaaggttaatgaattatatcctctcatccaatacagaaattgcctttaggggtgagacagtcatttcagtcttgaaaatctactgtacagggagtttaatgcttttcaaagtggcggattttattttttggagagctcgattacaaaagtttctttaatatttagttaaaatatgctttcccataacttccacatatctagctcaatccattctcagaataaaacaggaaaaaaataacaaaagagagttcacagtagtaatgaatgggcaaaactggccaaatgaggtcttcaggcagagggctgagttgagcttaagagatgactgaagaagaaacagccatgtgcaaaggcagggccaacgacagagactctattttgtgttgatctagatctattaattgacattctttagatgtcattatttaatcagcttcaaattcagcctattagccagccccactgttctttatcttgtacccaatattctcaaaagagaacttgaaaaatgtggtgtaaaatcctaagttatgctgtctctaacagtcttctcatctaaccatcaagcagccataaaaaaaatgaaaatgaggtgcatgtgacatggcagattttgagagtatcacgctgattcccagcagcatgttatcctatgtaatcattaataatcagtacgatgtcattttccaggattttgttgctcatcaacatcaaacttattggtttgtaaattttaaaattcatctctttactttttaaacgttaaaaaaatgttttctaatctccttatatgacatcaccaatcccttcccatgttttctctgagttttccactggcaactcttttcatgggaggaggagtgacttttagtggatactggataagaagaatgcactcctgttgagtagaatgagatcccatggcagcacttctaacaaattagacctagtctctgaacaaaaacaatatgagttaagatcgtccctaagattatctagaaaagaatcccgttcccataaagctgagtaacattttggtcagatttgtgtcattttaaaagccaaaatatttacctaaaaagcaagtgatttgaatgtctcagactaagttattttttactgatctatggccctcaaatgagttgatgaccttcagtagagaaatggttctttatttctgatttgtgagagtcatgcgacagcagtggatgggttaagaaggttagaggaaatttgttacattgctttttagctgttgttttttagtttggtgaacaaacgagataacatagctagtgccttttagtcataaagcaaaaataaaactacagtgttttctaatattgtaccctaaacctatgcaaatctccaatttacatcacccacaagccttctatatttttgcagattttaactagagctaaataataggcatatatttatacttaattgtaatcaaatgtaatgacgtgtgcaaaacaggctttgctcaaagtgctctttatagatgaaatatgattattgaacttgacagtagatcattcattggagggaaaagtgattaatcacttctctgtgcctctaccttcctaccctttgatgacaccggttatatttcaagattctcaatgctataaatgaacactttactgaagaagcatctttatccaatgcaaaatgaaatgtgttgcctaagactaataaagtcatttacaagtttcaatgaggagcaaatataaatagtaaaaaaaaaaaaatccattatttaacagcagtaaatccagtatgttttggtaaaacagttttcagagaagctctacttacgttagcttttcctaaaccttgctgcaaagtgtcagttctttctaatatacaatcaaaggaattttgtgttgggaagaacatttctcatctttgtaaaggacatttagaggagagatagggaaaaacaaagatcatgcatgaggattatgtgtgagggtatggattgactggatttcaatcattattttaaaaggcttatctaaaataaggtgttctttgaaccaagtggagtctgatttccaattttagaatgtttccacatttaacactgacattcattatcctgaaaatgaaggcagatacacataatatctatatgtattttaaataaaattggttcaataatttttctcaaatttcataactttttctatgaatcaatgtgtcaactcattttttcaacttttcaaactgaaagaaattccattgatctttaataataatgaatttaatcaaatattaggcaaaattctttagtgaaagaactcagagaatttgattaggtgcctaaaatgtcatttttaacataaaaattaacaaaagcacaaaaatatttccattttatcttaaaaattaacatgctatgttataatacaaaaaaagccctcccctaccccagaatcctgcataagaatgtgaatggttatgtttgtttgcgcagatggggtttatatttatgtgtttcttttccatctagcaaatttaaatctaggatacaaatgtagtcattatcgtgtctgaattggtgaagaaagcccaaaatatggccaaatctacttgccccctaccttaaattatgagtttttaaaaatatattttcaggttagaatatttctcttttttctgagtttagctctctgaagcaagtgctatcaattcatgaaaatattaattataaaagttttatactgacgatttggtcctcataactgcccctgcttggtctatatttcaccttcatcatgatttattttctaatatgagattaatgttaaggaccataaacgttatgttgagaatcataaaacatgtgtgctaaattttgggaacagctcacgtatacagagaaagaagaaaataaaaagatctagcagataaagaaaatactgtttttggtcccatttagaaatgttattaacggcaatgctgtaacaccttcctttccaacacaatggcaagccatgggatgaacaagctcaagacatgtgtggtagcataccaattaagcaaacagttgactcatggatgcattactagcaatacttctgctccaacccagatacagatgctcttcaacttacaatgaggttatgtaccaataaactcatcataagttgaaaatattctaagtcaaaaatgcatttaacatacctaatctactcaacatcatagctcagcctagcctaccttaaacttactcagaacacttacgttagcctacagttgggcaaaatcatctaacacaaagcctattttatactaaagcattgaatagctcatgtaatttattgaatactgtactgaaagtgaaaaacagaggggttgtgtggatacctgaagtatggtttctactgaatgtgtatcacttttgcagcattatcaagtaaaaaaatcctaaatccaaccattgtaagtcagggatcatctatgtttgattgacaggccccagcaagcatccgcaaatgaggaaagaatagagagaggagaaagaaagtactagatgaagacaaagaatccttggtgataggatcttcagacagagaggctctagggacttgaaacctggaagttcagcataggcatttagtatatgttgagccttagggaactcatttatcaatttgatatcactcctttgtatcactgccatggtgaatgatcagaaaggaaacacaaactccttctttaagaactgcaataacgaactgtttcttcttcttcttcttcttcttcttcttcttcttcttcttcttcttcttttttttggcagaggtggggtgtctcgctaccttgactaggcaggtcttgaactgctggcctcaagcaatgctcccacctcagcctcccaaagtgttcggataaccggcattagccacctcctctggccaagaactgtttcttttgattaaattttgttcttcctactccaactttccttaaagataatgcttccttaaagataaatctaatggcttaaacacacacacacacacacacacacacacacacacacacccacacccacacacgcaaagtatgtattcttttttatcactctcctcctgtccctcttacaccttgctttggaactgactggtgccttgcatctccagtcatttatcacacatcgtgtagaccgagattttcgatattaaaacattcagtctgccaatgtacgtaggaagcaccctcaatgtctttaaaatgctattctgaaacatttaaagagggccatctgcaataagaatgatcattagatgatgataaacagtactgggtcacagatggagaaagtaatagtatttgagagccattttcatgttaatgttatagattacatattaaagaaatgtgccagtaatgaagcaaacaacaaagagggccattggagaagaacagttatgctattgaaagcaatgatataataagcagaatggccccaagccatctgtttttaaagcttaccatatttaggctgttaggaccattccactgtccatggaggtgccattctgagataacagggaagtgggcaaaactaatacaaattaaaccattgtcagtaatttttatcataaattgatttttccctctacaaacatatctaatgctcccaaatctgactatttaaaaaaatgtttcttagtccttaatgtatgcatatcacaactctgaagacactagaagtatagactatagggttcacagtcttaaaatgaggattttagatattgattttcattaacgctctcctctaaaatagtttcagtcttttgtgcttccaaaattagaactttatccttaggttttgcaatttggatcttgtaaggagataaagagggaagaaaaaaagtttgtgattcaggggtgtaataaactccagctggcatatcatgagcctagttatgtcaaaataaataaatgatcaaaaatcttattaaaaaacaaaaacatactggaactttggaaaataaatttaggtaaaacaagtgaaatgaaaataggaagaatattaatattcagaagctgattgattatgtattagccagatcaaagcctctgggtgataatgagccactgaacagggattaccacctgtcctgttcaactagcagctggacttaccaagaacagctggacaagaacacttatataaaattagcctttagaagcataagctaagttttttcacctgcttctcagatcggcatctttatcactcatgccagaagtaaaaagcttttcatattttgatgctgtttttgccttcaggaaagcacagctttgaacaccaatattcccagccgcttgctaccaagtaatggaggttgtcttctagacctaataagctaagatgtcagatgcacttggtttttcctgtcactggctcatcttgtgctcttatgtttaagccactacaaattctttcaaaagaaagtagaaatataaattataaagaaagattttaatgtcatttattcctatattcttactcacgaatcttcattttattgaaacctatttaaaatgacaatatatatgcacacttgggaagtttatcagataattttgatataagacgataggttaaaaataaggcatatgacaatctttatttggtgctctgaattgtattaaagtcaccagtctgttttaagagttatcatggaacaagtgaatgagtaaatataatagtctacttccttccttctcaaagtgtggttggtccacagattagcagcattagcatcacctgttagaaatgcagaacatcatgtctcattttagacccactggctcataatctggattttaacaagattcccagacaatttgtatgcacattaaaatttgagaagcaatgttcctgtgagcttaatcagatcctctctttctttctacacgttttttctttcttttttttgagacagagtctcactctgttaccgaggcttaccaaagctggagtgcagcggcgtgatctcggctcactgcaacctccgcctcccatgttcaagtgattctcataactcagcctgggattacagctgggattacaggcatgtgccgccatgcccggctaagttttgtatttttagtagagacaggtttcgccatgttggccaggctggtctaaacctcctgggattaagcgatctgccctcctcggcctcccaaagcctgttgggattacaggcttaagccaccatgcctgtccctgtttctccactttgtattggaatgcttttatttgaatatgatgttttagtacaaaccacagcctaggaggcctgggttttaaagtaactaatattgatggctactatgcctgctatgtataagtgtaacgtacacaggttgaacataaagaggaggtttcacataagaatattataggaggtatcgtgaccttagaacatctgtacatctgtataatggaacctatttctttcattagaccccaatctgaaaatttctctgtctgccaaaagaaacagagaatccttctactcccacaacgcaagagaggaaaagaaaaacacattctaagtggcaagtaactggcagcaggcactttgtataaataccaaaagtagcacgcgttagcacattgatgacgactccttatttcaaacctgcacttggaacaactgcagatagagactaataattcttgtcaatgtgtattaaaagctctgacaggagaaaacaacttgtgcagctcaagattgaaagaaagcacaatgaggagattcaattaaaactggatgatgggagaagaaagcataatctataggaggacaggtataaatcctctttttctgatttgtccagtctctactaaaagagattgaaagctgatatcagaatcctttgccatgctagttataggcatttatttatttaggtatttatttacattttttaattatatgcttttatgtataatcatgcttcaattacgtgtacagcaaatggtaaatatttctcatttatataacatgaggtcagtcattcctaatgaatcttttctggtgccttaaaacctcccaattaaagactccttcaaatactccagtcaaagacaccaattaaggattcctcttaatagataaatatccaaaccaggctgtcctcaaaatgataaccagtgtcaagattccagtgttcaaaaaagacagatcagtaagcagtctcccaagccaattgactgtgtgccaattccacccttggttgaagggagagaaaatgattgcttcagagcagaagcaacggtggaagcagaagaaacagacaaaaaaaaagtgggggcgggagaggagagagggttaagatgcaatgggacagtaagatgttgtggagtagtgtgaacccggaaatcaattgggaaatagaacatcaaaagaacacgccagtatttttgggtttttgtttgctcctctctaaagaaaaaattctgtctaccttagacaagcacttcaccagttaagtctgtgggaagcatctacttagggcaggtaggccaattggtatcttcaatctttttcaaaggcttaaatttaggcacatccaggagtaagaaagtccttcccttcactacgtgcaagataaagctggtcaatcgttgagccccagctgactaaattttatgtcaggtaaaggaagcaatgtgggtatgttcccgacaatttatcagataaccaagtacaatcccattaagataacggctatagtccttgaattgaagacttatagggccatgtagaggtggcttttgtctaaaaaggacaaaggaactgaataatgtggtcagttctctgccacagagacatgaagacgaaccaagagattttatgtgtgtttgctcattttgtcagaaacaacaggtgacttaattacatagacttcagttcaaaatgctaagaataactgacaactgacaactttggaggacagattcctaccaaagtaatcacattagtgctgctctcagtcattcaattagtttatgattttcaataaatgaataatcatataatagaataatccaaaatcttatttttaggttttttgtatatataactagtattaaccctctctgtcaacatttttgctttccttaaagaaatataagaacataaaattttagtctaggtgtggcggctcacatctgtaatcctggcacgttgggaggtcgaggcgggtggatcatctaaggccaggagtttgagaccaacctggccaacatggtgaaactctatctctataaaaatacaaaaattagctgggcatgatggcgggtgcctgtaatcccagccactcgagaggctgaggcgggagaatcacttgaacccagcaggtggaggttgcagtccactgcactccagcctgggtgacagagcaaaaaaaaaaaaaataaaaaataaaataaaatccatctcaaaaaaaaaaaaatcaaaatttaacactctgatataccattataattatttattgtaattgacaacgcaaatacaattttgcttatttggttgttctgttcgttgtaaatggagtacaaattctaatttttgttagctctaaatcaaattttaaaagtaaacagaatgtttaaagttatgttttatttgcttaacataacacttaaaacaagatgaacagcaaaatataagaccaggcctgaatccactgagctgtctcctctatgaacttcataaggcatcttacatagagtaagcagacagacttccagacttacagttagaaaatgctggtttgaacctgggctctaacactgtgatactgggggaaaaaaaatcacataatgtattgaaataataagtattgttgactataaaatggaaatctatcctacatattttacgatattcttttaaaattaaatgaagtaatatatgcaactttatgtaagtaggtactttataaactagaaaattaaataactgctaatttattttttagtttagtaaagtctacaaaaacatcacttaactatatatcaaatatagtcacttaggttattattctgtttattattattattattattattattattattattatttgagacagagtctcactctgtcgcccaggctggagtgcagtggcatgatctctgctcactgcaacctccgcctcctgggttcaagcaattctcatgcctcagcctcccgagtagctgggattacaggtgcacgccaccatgcctggctgatttttatatttttagtagagatggggtttagccatgttggccaggctggtcttgaactcctggcatcaagcaatctacccgcctcggcctcccaaagtgctaggactacaggcatgagccaccatgcccagtcttatttactattattttattattttaaaaatcctaatttcctgaatttttcctggaaatgcagataagtaggtaatgcatttggtgatggtagtattaatagtaatgagctaatacctcatcctgaaaatagctcaaagattaccttaagtacatattgactccctaaatatgtgaataacaaatataattgtcacataaatacaattatgcaatcatgtcaactaaatacaatttgcaaatattttgattgtttaaggttgtattttcagtgtactatttaacagttatacatatcttattagtctacaagactttagactacaaggacagtagtcttcatggtccctacctgcctagtatggcagctatgattatttgctgaatgaataaaaataatactctaaaaagtgtgttcatatgaataatttttcattcatgatgcctctatcctaagcatcttatatataggatcttaatccacagcaatctgaattccctgcaaaaattaaaagaagtctgatattccttcactctatataaccttgaaaagaaacaaggcaaaagcaaacaaacaaacaaacaaaaaatccagtaacttgaaatgagactaccaggtttgctttaggcaaggtaggctatgaactaagcaattttaaagcttggagtgaggacaatttaagtcaaatcagttttttggaatgtccacaagacactaagtatatcatgaaaataacatttaaggaaaaataagtacacaaacatgagagtaaatgaaaatattctagttatttgcagacttggatgtcttaaaatctaaacttttttaatatggtaaattaaatgacaaattcatatttaagtgtaaattaaataaatgtcaactataaatgaattatattatttgaaaatggaattatatctgtgctattacgcttttcattagttgaaagtacaagttgcaaactagcagactttgggctaaatttggcatgcacaaatgttttgattagcccacacagtttttttttttttaatctgaattactcaacatttaaatattcagagatattttacagaataatccaaccttctgacttctcatttaaaaggaatgatttgtccatgctgggctcctattcttgcatgacaataactttccggagccaccattctataacggcacatgtattctatagtccctaccagctcccattaacttacgcttcgctagccttgcccagttacagtagcaggctagcccctctgttggcatttcagtttgcaacctctggtttagaccagcaaaggctgaccatagcaatcttagagtatcttagtgtgctttaagtcaactgacactgacaaaagaagaaatagaaaattggaatagccctgtactatttaagaaataaacactgtaattataaattttcccactaggaaaattccaaggccaaatcatatcactggcagaaataccaatcttaaagaaactcttccagagactagaagaggcaatgcttccctacttgcctttatgaaaccagaataatccacataccaaaccttgacaagaatggcagaccaatataactaataaacacagatgcaataactctaaaggaaatactatcaaatgaattctaaatgaatgtttagcatcaagtactgggccaactagatatccatattatgaaaaataaaactcaatctctatctcacatattacacaaaaggtcaattccaggtgtactatatatctaaatggaaaagttaaaaaatagtaagtttctagaagataataaaagaggatacattcattatcttgtattaggaaagatttcttaaagaggacacaaaagaattaaccctaaggaaaaatttacatattggactatattaaagttaagaactatcaatcaaaaaaacaatttaattaaaaggaaagctataaaatgggagaagatatttgcaacacatacaatttacaaagggctacaaactagaatatgtaaaaaaaactcctacagatcaataagaaaaagaaggatgaatcaataaaaaaaataggcaagagactgaatagatacttcacacaacaggatatccaaaatggtcaataaatacacgtaaaaatattcaacctcataagtaatcagacaattgcaaattaaaataacaatgagattctactcacacactcactgcaatggcgaaaattttaaagactaacaagtatcaagtattgttgagatgtggagctactagaactttcatatactgctaatgatggtgtaaactggtacaaccactttggaaaaccaggagtatctactaaagctcagcatatgcctaccctcaacataggcaattttactgcaaagtatataccaaacacagttgtacacacgtgtgtgccaaaaaacgcattaaagaatgttcataggaggccttattcataatgtcttcaaactggaaagaaccaaaatgttccccaacaatagaatggataaattatagtatacattttaaatgggatatcaaattgcaatgaaaatgtatgacagattcatgcaacaacatgagttaatctcataaacacaatgttgagtcctagatacaaaaggttatatactgtacaattccatttttatagagttcaaataaacaggcaaaactcaaccatagtgttataaggcagagtagcagttacctttaagatgagggaggaatagtgattgggagagggaatgtgggtgaggtagggtggtgatttctgaggtagtggttatattctatgtttctcctcaagcttttcattttgaaaattttaaaccaattgaaatgttaaaagaacacccataaaccattcacttagactccccaactgttaacataatattcgctttctctctctctctctcaccactcccccaacccggtgtgtgtgtgtgtgtgtgtgtgtgtgtgtagtctggtttagtgtgtgtgtgtgtgtgtgtgtgtgtgtgtgtgtgtgtgtgtaatctggtttagggctactgataatgttttatttactgtcctagatggcgaacataggtgtattcattttgtgataattgcattgagctgaacatgtttcatctgtatactttctgaatgtgggtcattcttcaagcaaaaaaaagagattcaatcaacttattttttgaaaacgccctcgaaaacaatgcattcaatacaacacattactgaaatactatgggtaatgattttttgttgttgctgtttagacagcgttagggaaaaactacaccatattttctgatctatttattgaacaaggatacctcaatgtggcagtgaggcttgggttaaaattgttatgtcacagcctcacctgctggttgttttccgtagccatactctacacttgcttctgtattatatggagataagaaatctccccatacttgctgcttttaaaatgtttttaagacaaggttgttcagggcacagaatgagacacagagcggggctatgggggttactgccagtgcagggtagatattaaattgtcctatcagttaatcgactaagtaaaacacagttctgactccccctgccaaacaaatggttaaacgagcaagctaaagaaaggacataataggccaggtgtggtggctcacgcctgtaatcccagcactttgggatgccaaggcaggaggatcgcttgagccaaggagttcgaggtcagcctgggcaacatggtgagactaccccctgctgccatctctacgaaaagaaaatacaaaaaaaaggaaagcacataatattttccaaagcttagataaaaagtaggatagatgacctgaggatgaaaaagaaacataattatagaagtttttcctttgtgttgtttaccaacagaaatgaattaacaatacggcacaacagaacaaacacacagcttagacaaaagcaacttagtcccagattctagtccatagcaaatgatctaagatagatccagacatctcaaagcctcagtttccaagtctgtgggaataagaataatcatatatgatactcaaacattccatgggatattgtaagaatcaagtgtgataatagaggtgaaagtgttcgataaagtgctatacaaacacatggggctatctataagttatctacctgaatatatcctctacccgaacatccatggcattagaaagaccatgggatcaggtatcagaagatctggttttctagaccagtttagccatgttactaaaattactttccccttttggacttccattttcctatctgtaagatgaagagtttgggttggattatctttgacattctttcttcctcttacatttcacaattttatctcctcacatttgagtaaacgtacttctgcagtctaattagctgactgaatactgatgacccgttatagaggtgtgctttcagagataagttaaaggacaagcttgtaatcttagggtaacagttttgggagaaggagatccattcccttaaatgataatggcagaaatgaccactaaaggaaggcaagaagtatctggtttatggcattctgaatctatttccccaaatggaaatcagatgtaaaattcttgtgctcagagacgtagtgttgattgaagagtgcagatccacgtgattctcttagtgtcatattcatgtgtgtttcagtagtgtaaactcggaattgaatagttgcctgtgtttgtaagagacattgtaggtttgcttttttatttttattttttcttttgagatggagtctcactctgttgcccaggctgtagtgcagtagcgcgatctcggctcactgcaagctccagccccgggttcacgccattctcctgcctcagcctcccgagtatctgggactacaggcgtccaccaccacacctggctaattttttgtatttttagtagagactgggtttcaccgtgttagccaggatgatctcgatctcccgaccttgtgatccgcccacctcggcctcacaaagtgctgggattacaggtgtgagccaccgcgcccggccgtaggtttgcttttaatatactttcagaatgtgtgtgttagcatttttttttcatataacagctttattgacatttagtatacataccatacgattcgcccatttaaggtgtacaattcaatatttttgtttgtttgtttgttgagactcgctctgtcacccaggctagagtgcaatggcatgatcttggctcactgcaacctccacctcccaagtccaagcgattctcctgcctcagcctcccaagtagctgggattacaagcgctcgctatgaacgcctggctaatgtttgtatttttagtagagatggggtttcaccatgttggtcaggctggtctcgaactcctgacatcaagtgatctgcccgccttggcctcccaaagtgcttgcattacaggcgtagccaccacacccggccttgacttagtactttgtattggtgatatatggaattgatttcaacattttttgccattctagggtgaaagtgctacaataaattaaaaccttataccagccaaagaagaggcagctctcaattgtgaatgttgagaatatacttacaagaaaaatttaactttggtgatgtaatagcttcatttgcattacctaaagcttgaagtcaaaagctaaagtattaagcgtacagaagcatggactctatgaaagaaacaatccaaaaagtgacttttttttttttttttttttacaatgggagacattaagaactttggtaactaactcttcaatatgtccctgatgacagaccaaggatttatgaccagaagaagctattaagaaaatcttcctgaggtgttaaacattgaacatggattattcatgaaaagataggaaatctcttttctgaatcagaagagagtagattcttgttgatctggagtggtttccatttacttctgccatgggaataaactgaatgattgctctataattgaatagtcttttaaaccatactctataaattctataactatcttataagtatggtatctaaaaataagactgatagcttgaggactcatagttgtgaaaaactattgaaagtatcattgaaaaggctcaacgttttctattttcaaaaagctaatggtaagctattttttaatccaatggatgatggtttcagtaaaggcaattttgtcacaaagatttttatgggaatctgcagtatgtagaaagattctcctgaggaaacgtgcttactgctccctttacagtaggtcaagagtctctgatttctagcacagaactattttctaggcatcttttaaaaccctacctaaaggcagatgagtgggccctaatgttacaaagaactactctgagctaagtgaaagaattacagttggacaagtgggaacaaataacatggttcatagctgcaattactgctcacatgaattttacttataatattcctgatgccaagtcataaatgctctcaacatctcatctgactggtagaactttcttactggcatgagattcctaggatttttgttatcctttagcttttatattctacaccatggattggtaccactctaaattggatcaaattttggaacaatagacatcaagtaagatgtttctaaacaattagctattcttagtcatttgaatttctatgtcataacacatgctttggcatttatagagtaacctactcttaagaaaaaataatctcttctaaagcccgtatttaattttacaattgtgtatacacaattgtgtatgtatatagtaagcatggtcactgacaaatgctaatgtctcagccagggaaattgattgacaggaaactggagaagagcccctgaaaactcaagtctgtaattatatactacatctgtgagtggactacctgtatcagtttatacaccatcttccaaatcccaaagtttagtggtaaactaaaccttgtctgatgccctgtatggtctaaaaaagaggagaggggttgaaaagagcaagaggtagagtagagatgcaatctgaagaccgctattcccagagtgatagagcaagtgactagtagtgaatgtgagggacctcctgtttgtgtggtttgtctgtcatataaatcttgaaacttacatagatttttataagggaaaacatcagcatatcgagaagaaagatataatgtttaaggggatcattgccactggactttatttagattttggcttgcacattctatcagaatgaaaagccaacattgaaatcttttcatcatataagagaaaaaggaagatagtaggtgctggtatcacaaggctagaagcggttttcatagtagtcagccattaatctttcccttatgagtttgagttatcctaacattgtgcatattataaatacagacacctgcttggcttgtactgcctctcaacaaagtgatggcagacagaaaacctaaaaaagttcttttctggactagctgtggattaggcctagattggatcgccattagaaaagtggggaatgcatatgcatgtgtgcatacatacaagttctatgggcctacagtcctggagtgcacactgagacatgtggcttctgggggttgctgcctttcaataccacagaatcactgggttacagcccattggctgagtagttcaagttatctatagactcatttattatgtgacagagctgatgatagcatagatgcatccctgattgaaagccagatagatcctttgcttcattttgctttgttagtgtgggctagcacaggcttgcctttaggtacctgagtggaatgtacaacttctagtccttacatgtaatggagaagactgctatgattcatcttgaaaagtaaaatgtacacacatacctgtctatatccaagcttgggggtaacacttctgggtttgagctatgacatttttgtataataaatgaaaattaaacttcatttgaatttcataattacctactactggtgtgatttagaagcagctggtaggtcaatatggtgctcttttatgcattttagtactgagaaaaacataagtgctagatatgccacttttaaagtttcccagaatattagaattcaaacacacacacacacacacatacacacacacacacacacacatacacacacacacatacagagtaatagtggtaataccactgccagagactcagttaagataatattgttctctatttgactcctctttaattccgtctaaacatgaatgagaataatcattgacctatatctacaacatgactaaatgagttcaccagaggatctaacagcataaatctattttccatgaattaaattaaaaactcatgaatacacataatacttttagattgaaccaaatattttcatgaatacagactctcttcatccacgtaggaaaccctattggtgagcagcaggttggcaatgagtaaatgctgctcagcaggtcagacgtgtacagctggagaaagatcatgaaatttagctagtatactaggcaaaacacaaatctggaaaggagatgatccacattgcaatttttaaaaaaaattctatgtagacttagaggtctagtacagtacacatacacacaaggaacataaatatcttctgagagagtttctgtaggctttacctttgaagtttttttctttttctttttttgggaaacaaaacacaacaaaacacctcctgttgccctgaatgctaatgatggaagactgttgctatggtgatgctaatttcaacaccgttgcctgtggacttcacatgaactcgctgttttaacttctgcaaatgtcatttacaaaatgaaaacccattaatgattagcgagggcacaatgttccactttaattagaataataaggaatgctgatgcacaaaatacaggtttgtgaatcactactgagcctacactgtcaaaattaattactacggatgaggatttggtacttttctttttttaaagaaagctttagagtagaacagttgtattttgacttaaaaggaattgaaaactctctcttttaaatttgaaggtaaaaaaaaagcacatctccctaacagtacacataaaaactaactgcaaagagcaaaacaaaagttggaacctagggtcagatatttctgagtaagaactgaagaaaagtcaactaattgttcgtttagaaaatagggtaggctgggtgtgatggctcacgcctgtaatcccagcactttgggacgctgaggtgggtggatcatgaggtcaagagatcaagaccatcctggccaaattggtgaaaccctgtctctactaaaaatacaaaaattagctgggtatggtggcatgcaactgtagtcccagctacttgggaggctgaggcaggagaatcgcttgaacctgggaggtggaggttgcagtgagccgagatcgcaccactgcactccagcctggtgacagaggaagactccgtcttaaaaaaaaaaaaaaaaaaaaaaaaggatgggggggatgatacaggtaagctatttgaatatttcaaaaaataactatctgaggaaaaagtgctgcatatggtaaataccttgatattagatatatttggatttatgtgtccacacaaggaaacagagaacatttaaacaactgggaatatacaagaggaaacaaaaataattctattctctccaatggtaaaagattgagttaccttaaaataaagatttttttttcacctgcacaaattttaaagcaacatctgaagatgagttggaaagagtatgttccatatttaaatttgtttccacatggtttgctgcaaagactgcgtcggttgattttattttcgatgctctacatttccattctgggtcaccccctattcagtgaaatcattttatgtcattggtgcagccaacaaaaaaccgatggtgtatttgctggatatggaaggtgcaacacgcatttttcatgttacaaaaatcttcctacagaagttccaaacctgttggatttggcaagatatgatgaagggagatgataccaatactttatatagtttctagagtaatccttgaaagacttgtattctgggtcttcagtcaagtaatattatagggtctgtagaactatcaaattacctgtgttattgaggtgaaaggtgaatttgtggtggccttatttgtctacctgatattaagccaagggtactgcacttgggaagacagctgacatctgccgtcaaaaatgtaaagtaggaagttagagtatcttcgtatttaggtttaaacttgcattgctcaagaaaaggtaggatacaaagttatataaacaatatcttttgtattttatcagcagattttaaaaaactggaagaagacattaccaacatgttcattgcagttgtctaggtggtgatgggcacttaaatatttttaatctttttctatgttttccacagtgaacatttattatttttgttatgacacggaaaacttacaaatattaatttctaaaatgtattgctcagacttccagtttcaacttggagatggagatggagagctgcaaagaggttgctcccatacttgtagcaagaaaactgctggacagataaattaatgacttttcatcagtccatcagagaaatgacattatagaacaacctgaaatctggagagagattggcctttagccagaagcagtgcctgagcatttggatccctggagcagatgccatataaactagtagggagattaaattgttgggggacatgtgggagctagcctgagagtgtgaagatcctgggggctactgccataggtggagtcccaaccttttgcaagcttcttccttcaggaactgtaccttgccttcacaaggaggatgcgaagaatctggagaaagcctccccaacaccctctgtgttgctgattggggaagggtcacagtagctagtcaccatgaatctgcttatacccttctcttcagaggaaaagacatcacattgctataaagaactacccgtgactgggtagtttataaagcaaagaggtttaattgactcacagttctgcaggctgtataggaggcatggctggggagccctcaggaagcttaaaatcatggcagaaggcaaaggggaagcaagcacatcttcacacagcagcaggatagacacagtgaaggggaaagtcctacatactctcaaataactagatctcttgagaactcactcactatcacaagtacagcaacggagaaatctgcccccatgattcattcacctcccatcaggcccctcctccaacatgtggggattacaatttgacatgacatttgggtggagacacagaaccaaaccatatcaggcactgaggaaataccactgcattttaggggaagggaacaccagatctcatctatgtgtggttttgttttgttctttttttgtttgtttttttttgtttgtttgttgttgttgttgtttttcagccttatgcaggagaaagggccttggggccatagactgagaacactggtggatatccactgcagctccaggaagggaatgggaggttgaagttactctacctctggaggaagggaaagaaataattgtaaagaccacatccccaagacccaggccaactgtgtattaattcaaacattagagaatgcctctgcccgacactcaaccactacactaacaagcttccaatgaggaaacaaagttaccagaggaatttgaagtctctggtggccacagcagcaacaaaactcaacaatgacaaccaaagcaactaccaacatcaaacacagcccaattcccagtcagattaagataaattaccatgtcaaaggtttatttacctcagtatctattacgctatctaagatgcctgacttttacccctgagatacaaagcatgcctaagcaagaaaaatcacagtctaaggagacaaagcaagaatcagaaccagacttagatatgtaacagttgttggaactatcagacaggaaatttaaaataaccataattaatattttaaagactcttgagggaaaagaaagacaatatgcaagattagatagaaaatatgtaagattagaagacaatatgcaagattagatttgattcactcttatagtttccagctctatatttcagtatatttcagtatagagctggaaactataagtgaatcaaatggaaatgctagaaattaaaagcagtaacagaaaagaaaaataccttagatgggctcatctgtagattcaacaaagacaaggaaagaaccagtgaacttgaatatagggtaacagaaattatacaaactgaaaagcagggggaaaagtaaaaaaaaaaatgcaattgcaatacaaacacagtaggttttcagtattaagtagggctctaggaaacagctatttttcagattaagtaacagtttggtgcaattatgctgatcaagcataaagaactataaattaaagacttcactcaaagaagacctctgacaagcaaccaagttgctacaaagtatttaaaaagctagtgaccaaccagttgtttacagtgatatattttgcaatatttgatttagattaagagttctaggaaatacaaaaagatccacagtacaaaaaaacaaatgtgttccttctaatgctcagaattaacattttatctttgctcaaagcttcttttgaaataaaatacaccattcaagatgaaattccgatcctctctgatgccccctctcccatactacaactagtatcataactttggtgtttatctttccaggcttttcattttaatttaatttttaaaaattagtcttttttatttttagtattgcacctgtacttcaaaaagcaaaacactttaaaaagtgaccttccagaatttagcatcagaatctcattcacactcatggtttcagttactagctatatacaagtaatatgtaaattagtgactccaacccagatgcgcctccttctttctttaggtgcacactatctgtctatttacagtgctttttggatgtcaccaatcatttgaaatccaaacatttacaatcaaattgccaccctaaatctgatctttctttagagttccctaactcactgtaaagaattaccaactgtgcattgcccagaaatctaggtgtgattccttgacatgttttgctttctctttgcgcccttcctcctatgatatctatcctcaaatcttaaggatttttacctcctaaaaatctctcaaatctatgcctttctcaccatatccaaactatcatcatcttggtccaaatcccatcttctctcacctggctttcatcagtaaccttcaaacgtttgtattcataggctcctcatccaattcatttgcatcagccagaggactttttgagttttctcctcacctcctccagccctagtcatgctgtccttttaatcccttgtattgacaagttccctcctgctaaattgccttgacacatgactctctctctctttttgtgttaatatgtattcattcttagtgtcatttccattatctattccctggctatactttggaggtatcatgcatgttgctcaccaaatgtaccctttacatctagcaatgtatctggtgcacatattctgataaataaacatctattgacaaatgaatcaatgaatgaatcagtcaagagtatatctttagataaatgtttttcttaggtaaggagaatcaaaccatttaagtgcattagaattaaaaagcattttagcatttgtgagaaattctgaaagcagtaacaagtagcagtttctacttttacaaatataactgaggttaaacaaaatatacccagtaaaaaataacttcttactaacttggctaattatgggtgaaattggtcatttatgctgtgacaatgatcagagacacccttggaaactatgcttctttaaggaataatgatgccattttatagttttatgctttcattttagcatttgagaacagttcacaaacacactaattaatctctgcaatgatattgtactcctatattacaggccaattcaagaaagtaaatcacacagatttcaaaagcataggaaaaatttttagatgcctaagaatatactctttacctcctgtaccttgttatatatgtctttatagtcttagatagatctttaataaagaattgaaacagaaacagagatccttattttagctcctttatgtaaatcatatgcatatttatgacttagttcctttattttgtgagcattttatatatatatatatataatataaaatataaaatttacaatagctggtacaatagcccccaataaatatagtttgcttaattaatgtaatgaattcattaatacatttgccttttgcaaaacagaaactagctcgatattgtgaagtcccagggtttcctccctcatcccaatatgatggcatcccaccccatgactctaagaaggatgtatatattgatgattacaaaagttaaagctcttgtcctgacgtcttcccctagcttcagatccaaattttgaactgcacagctagatacccaataagtacctcaaacttaaacatgtctaaacccaggcagctctagggtttctacacggaagagtagctatctagttgacaagcaatttttttttgtttagattaaatgttttcctgttgttgctggaagcaaagtatggctaatgggcaggtattattggagcacagaagctcttcaagccaccctttaagacatctctttaaaaaattatttatttcatttatttgtaattgacaaataatagtttgtatatttatgggatacgatgtgatgttttgatcttggtatatattgtagaaagagttgatcaagctaattaacgtatccattacctcaccaacatatcatttattttttgcggtgagaacattaaaaatctattcttttagcaattttgaaatatatgagacattattattagccatggttaccatgtactgcaatggaacactaaaacttgattttccctaccaaatttgttcctctttaagtacctgttcctgctgaaagccgaggagacacctggattgccctctttctgtccctcctgacctccaatgcatcagcaagacctgtgattgtttctaaaccatattccctgattccaaccacctcttgtgatctccactgctacctttatctagatcttatctaacaccagtgcttcccacactactatctggtctccctgcttccactctggctcttcatatttcctcacccctaactcacgtgttccaccaaatgcattctccacacagcagccaattatgtcttgccaatctagtctactttcaaactgcattataacaaagcaccagcaaaaaaccaaacacctccaacaaacttcacctaggctttgataaaggtcaaggtttgcatttcaaaaattttcctctttggagttgcagaaaagaaatattcagggctgaatttcagcaaccttcttattagtatttacaaactagttatacttggctaatttgtaacaccattgaaagtgaggtttggcaataagtgtactttacattgtgaacattaaaaacaaacaagacatattgtctggcaaaatattttttgctgttgttgttgttgtttgaaattgtatatatttgaactaccttaaaagataatcagaggaagtcccaggtagctggacatttaaaagtttgtcttttttctttgaaaataatacatgaaacttggaaattgggaaaacatatttactataatattcaagtcaaagaatggagaattgcccaattagggtttatataaaattagttttcaaatttaaaaaaaaatccagactaaattatatctttataatgtataacccttaagagttgtttatatatcttctggttggttcataagcggaagagctgctgcactgttcagtatcatttccccatatttcactgagaaatgaagttcagagagtaatgaaattatgtaagggcatacatattattttataacatctatagaatttacatctttggactctcatgcctaaatttaatttcctattggtttattatttcatctccgcctgacttctgtgttttatatcccaaattaaatttcccacagatttccttaggtatattattactctataaaatggcaataatctgttcactatagccaacactattgcttaatcatctttgtaattattttatcatttctctattttttgttttgtaatacacatatttaggaaaggacaagtaaaccaaattcctaaattgacaaagtactacgtataaattaaacagaagttggtacagtcaagcatgaatctctgaataaagccaccaactttgagaagtgtttccaacaacctcaagtactttttttcttcactccactctttataaaacttggtgataaaggtgttcacgatggaactaaaagttatttggattaaaatattgctggtctgggattcatgcttccccaagcaatattgatttgctaggggatttttttctgttcttattcagtctttttaatttaaaatattttatatttatgttgctttttttctgatgttttactgaattaattctatagtttccaggccacggcaactactgtaagggtatggcccatactgtcagattatattattcagtgttcctctgctcatctcagatccttcagaggctgctatttttacacgttctattacacatcaggacttttaggttttaattttaaagaagtgttccacatttgagccctctgatataccctgagttatagttacagttacagttacagtcagataacttctcagaaaaaatgactttgtagtttgaacatgttttctccatccctccatgttaattttttccagttcacaagtgaaaacaagattagtatgctctgaatctaccagtcagtatgtttcatcttccacctcaacattgaactgcttcctttcaccttatacatctttttaaacaatacattcaaggacttggaatataattggcaattttgttgatgatgaatgaggctgagcaatataatgatgccttttgctactctatagtgctttcagtaaaaagaaatggcttgaggactaagagtatatgaaatatgagtgagagaaaaagctctaaggtccttgataataaagcacctttaaaacgatatcatgagatgatgtttctccctaccaaaaaaaccccaaaaaactatgtgtgaaaaaaaaatcggctctcttgtatcaacatcgggcattcatgcaattaaaatcttttgtatgtgtctggtaatgatatctaatatttaacagagaaaggcaaaaactggttgagtataactgaattctaaacttgaagtcttttcttccctactggataccactgcagctctgcctcaatgtatgtcttaggatttaccacttaccttactccaacttttttcaagatctattaagacagtggtccccagcctttttggcaccaggcatgagttttctggaagacaatttttccacagactgggaggcaggggcgggggtatggtttcgagatgaaaccgttccacctcagatcatcaggcattagtttctcataaagaggtcacaacctagatccctcgcatacatagttcacaatagggcttgtgcacctacgataatctaatgccacgactgatctgacaggaggcagagctcaggcagtaatgttcacttgctcaccactcacctcctgctgttccagtccatggtccagaggttagggatccctctattaagacataggcttacatgcattcactgaacaatgctggctcctgaagaaagcttgggagttttgatagaagaggattttaaggtgttttcctaagatattctcacaacagttttggtaataggagctactgaaggaatatattcacttaaagatgctttcttcaaaacagtaactttcaaagatttatagtttatagcataatctagccaggcaatcaaccccatcaacactcaaccccatctgctctcaacaaactgaaatatacaaaataaatggactgctaaaaaatcgcttccaaatgtaatttaataaactgtaacaccagtggggctatctagaatttaaaaaaataacatggaacttctttatctgttattgtctattttttaaaaattatttatttatttatttatttctagatggagtcttgctatattgctcagcctggtctcaaactcctggactcaagtgatcttcctgcttcggcttcccaaagtgttgggactgcaggcataagctgctgtgccgtgccatctatttttttgtgtgtgattttttttttctttggagatggagtctcaactctgtcgccctggctgaagtgcaatggtgcgatctcggctcactgcaacctctgcctccagggttcaagtgattctcctgcctcagcctcctgagtagtggggattacaggcatctgccaccacaccagactaatttttgtatttttagtagagacggggttcaccatcttggacaggctggtcttgaactcctgacctcaggtgatttgcccacctcagcctcccaaagtgctaggattacaggtgtgagccaccacgcctggactgccatctatttttctttaaataagcatacctattgggatcatagctcagcttccagtgcttaatcatcaaaatcaaaacaaatgatcaagtatttattattatttttacatgtgagatatataatacatgctagggatgatgcaaagatgcataaggcacaagcgttgtcagagagtttacagctgaactgaggagacaagggatctgaaaattaacaaaatatttcaagagttaaacaagaaagaaaacttggggtcttagctgggacgttatagaggctcttgctatttctaggatctgcttaaaataaggttaaaaattaattattacttatataattttaaaggtagacatgtataactgttatatcacttcctagtcctgaccctggccttttcttagacttgtgatttcctaaaacttgggacaagatgttaaggaaaaatatgtaggcccgctcatcctcctttttttcccctcttgctcatggcaaagataatttttaaactaaaataaacacaaattgtgtaagtataacatttggatctcacatcagactcacacaaatctcagattcttatctagtaccaatctttattaatgactgaaagaattatagggaagtgctgggcacagatagaacattatttccctggggaacctgaaataatcacacatgcgtttccaaaacatccatgttatttcccattatgatgtgctttggtttcatattaacagatacgtttttaaaaatttacacagaaacattgaaaggaaatcatttcagtctcaaaagttttccattttataatctgtcaattacaaaaatagaaaaacgttcatgtagctatgccctattctccagccagccacgactcataaatccaaacattccaggtttatttacaataagctatctagccaggccaggtataccctactaaaatcattttatagatagggatttgcaggtatctttcctctagttaaccactattaacaagataaacaagaaggtctgggaggtcattaacatgtttatgaagtggtctattaaggtcatttattcccttcacatcccccagggaataagtcacagacctgctgttaataccctttattctctttagtttcctcttcgttgtcctctctctctctctctctctctctctctccatatatatatatatatatatgtgtgtgtgtctgtgtatgtatgtatgtgtacatatagatatatgagtaaaatgtacacaaattacttttaattggatgcataaagatatttccaccttgaacttttgctgtgcctgctcagcccctcctgctctatctaggattcattcttttctattatttgatttttttttttggcagaaaagttcttgtagtattgatataagtaagagcgagaaaaaacaattaatctagcctttatttgataaagcacttgtatttacatattaacacagggtgcctacatttttcggatagagatttttcttttctttcttcttttttttttattcctagagacagagtcttgctgtgttgcccaagctggagtgcagtggcacaaacacggttcactatagcctcaactttcggccccctgggctcaagcaatcctcctgcctcagcatcctgtgtgcctgggaccacaagcacatgccaccatgccaaggatttttttttttttttttttgtagagaccaggtatcattttgttgctcaggctggcttcgaactcctgggcttaagtgttccttctgctttgaccccccaaagtgctgggattacacgcttgagacactgtgcccagctatattcagacagagatttttcttaatcttcagaaaacataagccattatttatcttcaaaaacatattaattgcccagattgcttttgtaattttgagtcattatgagaaaaagtatgagaaatacttcttttgcaccatgtagttataatgataaaaaataaagactaaagaatatcactctgcaataatgaatatcattctgcaataagaataaagtatcattctgcaataagatgaaatgttctgcatgtaatacatgggcagactcagtattcccccagctcaaggcttgggagaaattgtgacttatagccacagaccatatatatttgcctagtaaagctagaaccataggcctctggcttaagggaaggatgagacgatctgttctggaatggggggcggggggtggtgtcaaaatcaaggacatgcacaaatgttgcaaaggctcctgcagagcacttcttgtccatctaaattgaccacgcgctacctttcagaaagacttacaattgagggtatgaagagaaacacattccatgacatttattaagtatggtcttggccatactctctatcttagggaagccctgatggaggtggtggaatatgacttagaaatcctttgcttttctgctccattggtctatatgtctgttttggtaccagtaccatgctgttttggttactgtagccttgtagtatagtttgaattcaggtggtgtgatgcctctagctttgttctttttgcttagaattgtcttggctatacggggtcttctttgattccacatgaaatttaaaacagttttttttttaattctgtgaagaaggtcatggtagtttgatgggaatagcattgaatctataaattactttgggcagtataaccattttcacgatattgattcttcctatccatgaaagacctcagaaataataccacacatctacaaacatctgatctttgataaacctgacaaaaacaagcaatggggaaaggatctcctattcagtaaacggtgctgggaaaactctctagccatatgcagaaaacagaaactggacccctcccttacagcttacacaaaaattaactcaagatggattaaagacttaaatgtaaaaccccaaatcctaaaaaccctagaaggaaacctaggcaataccatttaagacataggcatgggcaaagacttcatgacaaaaacgccaaaagcaactgcaacaaaagacaaaattgagaaatggaatctaattaaactaaagagcttctgcacagcaaaagaaactatcatcaaagtgaataggcaacctacagaatgggaaaacattttttcaatctacccatctgacaaaggtctaatatccagaatttacaaggaacttaaacatattcacaagaaaaagacaaacaaccctatcaaaaagtgggcaaaggatatgaacagacacttctcaaaagaagacatttacatggccaacaaacatatgaaaaaaagctcaacatcactgatcatcagagaaatgcaaatgaaaaccacaatgagataccatctcacaccagtcagaatggtgattattaaaaagtcaggaaacaacagatgctggctaggctgtggagaaatgggaacgcttttgaactgttgatgggaatgtaaattagttcaaccattgtggaaaacagtatggcaattcctcaaggatctagaaccagaaataccatttggcccagccatcccattactgggtatacacccaaaggaatataaatcattctactataaagacacatgcatatgtatgtttattgcagcactatttacaatagcaaagacatggaaccaacccaaatgcccatcaatgatagactggataaagaaaatgtggtacatataaaccatggaatactacgcagccataaaaaggaatgagatcacgtcctttgcagggacatgaaactggaagccatcatcctcagcaaactaacacaggaacagaaaaccaaacgctgcatgttctcactcacaagtgagagttgaacattaagaacacatggacacagagagggaaacaatgcacaccagggcctgttggggtttgggggttgaagggagggaacttagacgatgggtcattaggtgcagcagaccaccatggcatacatatacctatgtaacaaacctgcacgttctgcacatgtatctcggttttttggtgtgttttttttttttagaagaaaaaaagaaaaaagaaggggggagatctcattttaattgatttagaccagaatcaaacattttaaaaattaaaaaaaaaaaaaagaaatactttgttttctcagcctgcagggaggtagaagagtgcttacatcagggctggccaagtttttgtttcattttgttttttgttcccctttattgcccaaagcagcaaagagtaacttaggtctctgcaacttgattgcgaagatacgccaaggaaaatccacctaacagtgcagggaaggactactagagtagttttggtgatgcccaagatggcagcctcacagtggtggattggccacatttggttatacaaatggccagttttcaatcaaaaacattagaaagttgaaacagctagaagcaatagctgagatgatgatgattattttatttgatttatttatttttattcgtataaatttctgaggtacaagtgcagttttgttacagggatgtattgcatagtggtgaacctgggcttttagtgtatccatcaccaaagtagtgcaccttgtacccattaagtaatgtctcattatccacccctcacccagcattctgcccttctgaatctccaatgtctatccttcttatcatgatgattttaagtatcaattctcccccctcccctttattagaatgacttggataagcctccaacttttttgaatctcagctgtttcttccttttttttttttttaacttttatttatttatttattttgagatggggtctcactctgtcacccaggctggagtgcagtggtgtgatctcggctcactgcaacctccgcctccctggttcaagggattcccctgccccagcctcctgagtagctgggaccacaggtgcatgccactacattcagctactgttttgtatctttggtagagatggggtttcgccatgttgcccaggctggtcttgaactgctgagctcaagtgatccacccaccttggcctgccaaagtgctgggattacaggcatgagccaccacgcccgactgatagccgtttttttctttattggataataagtggagtgttacaaggattaaatgggaagatacagatgaaacactttgtcatttagcacatagtaggcacacattaaactttgcttttcttcctgtctagcagattacatggacttatctatgagacacactgtttacagaaaactcatgaacaagaaatagtgaccaaaaggaaagaaaacaacaaaacgattccttctaaagcaacaaagaagcaagttaaaaattacacattgcactgaccatctgacatgcaatggctttggggaccaagatggatgtggataagctgagaaagaaaaacagaaaaaagcagttgagagtttcaggaagagcagcgaggcttttcagtttcatccccccaggagttaatggtatcacagaaaacgtgatcatttgccgaatgccgacagtgagctaagtctcatctaggacctgctcttagaagctttccagagtcaatatccagagatactgtttttctatcttgtacaacggtttaaaaaatttgcaacgtgacagcactgatttatacaatgcactcacagtctatttctttaaaaaagaatacatacacagagagagagagagagagagagagagagagagagagagtgttttaccgtgttaacatttttcctgaagaaagtatttaataccctctccctaccccctactcccccaccctatcccctggaaggaaggaggggaagactgaatgggatttggagttttcccactgagaaaggggcattttctgcaaccaggtcagtgttcaaaggactaatgctctaaggaaattatcccaaagaagagagaggcagttcagggttattaagttattttaaaacattgcctgggctgttgctgctgacctttgtgaagggaacaggatgctgcttcccaggggaacagaataagaagcaattagagaagcctaggagaggcccgggaatgtttgggaattcacacataccccaaattacgtgggaacgctaagaatgaaaataaactaactttgattagggacatatttgggttctagaaaatattctaaaaatgcagctcacactggggctatatctctatgagtgttttcctaaaaacctgaacactcagtatctaatagaggtcaataagacttcaatccagtttcagaggagaaaaggaaagccaattaacatttcttaagcaatattccttatgtgtcataaagtagaatgggtgtcacgttaagcaaatggctcaaacgaacagagttgggatatgatacagttgtttcaaatgcagatttatttgatgtgactactggtttttttctaacacgtgattatgtaagaaagtgcatgtttaagaaagttagaaaaagaaaatggggaaatagctgaaataatttactcctcttcttttggataaaccaacttgaatatgttctatgctcattctcacatttccaaaagtgccacgaatgaggcagggaatgctataccatgtgtattataatacaggattattttccccatacacacattaaattttagctgccacatgtataggtgtatgtatatatgttgccacctttccacatgacatatgccatatagaatgttacaacatttttctgtaaaataaaaatgtatcattgatgacattctgttaagactcagtggctactatatcctggcccaaaaagtaggtcctgtccacaatgctcagtgaaaaacagtagttgatcaatttaaagctctattgaccactagaaaaccagaagaagcctcatgaatgatatttaggaaaaacagactctagttctactgaaacaaagctagagctgagagtggtcccaggcattatctagttcaaccttctcattgaggttgagctaagttatactccttatcatattgttagattaagatagaacggaatctagaactcatgttttggtatgtaccattcatacatccatgccaaggactgtcccttaagcaccaaactgtaggagctatgagaaactctatcaaacactcggcatgcttcctaacactaaagttcatgtctagagggcatgagagatggatttgagtggtaaatctaaattgacacacaaatactacaagattgttttgaaggtgaaatgagtcagcaaactgaaaagcacatagaattactgacatatgttcatgaattcattccaatatttaccaagtacctgttatctgtgaggcactatgctagaaaaagagataacaacagctatcctcctggagtctgttatttcagtcaaggtgatacaaatcagcttatgaaactacaaaaaaggatgtgagggtttttttcatgaacctatgagacacagatgatatcaacatctacatctcccaacaagatctataaaaccaaaaccagactcagcactctgcacaacactatggcacccctttcactctctttcagttaatatcttaacctgaattgttttcatgattatatcatcaataatgtattaccaactattccttcattgtggttccagagcttactgagactcaggtaacgtgacctttgaaaccatcaaatggcagaggagaaaacacagcagagaagattgacctctgggttatctttgtgtactaaagccttttgaaaagtcagagcatcaggcttttggcagtgatttcaaaaatttaattaccccgaatcattcaccagcatcctcaaagactgacagatcaaattagacagctgattctctgttgcatccacttcttatcatcaatagtgctaaatagttaagtgaaacatttaatattatttgtcctttctatcccgataagattgatggtgcaataagaatcctcaagggcaatatgaagattcattttcacttctctggaaaatgatcacaaacaatttctatttcgaagtcaacattcacaaaatcagaaaatgttagtactggaaatgacctatgatatcatgtcattctgcttccttaaatgacagagggagaaactgaggcccacagaaaataagcaatttcccattggtcaagtattaatagctaggtgacagtaaagctggaactagaattcaagtcttgcgatgcctagcctatttaaaatttcccctatttaatgttgtcttagctgctaaaaggtatattttgaagaaaaatatacataagaaggatcttaccagaaatagcacaaaattatatactacatgatgtgttcacattgtatgaaagattatgacaaaattcaactgattttcaaacccaatgtcagaagacttgtatcattcttagaagagtgaggtgtctggaataagaaatgaggaaatttttttttttttttttttttgaggcagagtcttgctctgtcacccaggctggagtgcagtggcgcgatctcgtccactgcatgctccgcttcccgggtttacgccattctcctgcctcagcctcccaagtagctgggactacaggcgcccgccaccacgcccagctaattttttgtatttttagtagagacggggtttcaccatgttagccaggatggtctccatctcctgacctcgtgatctgcctgcctcagcctcccaaagtgctgggattacaggcgtgagccaccgcacccggcctgaggaaatgttttctatgttgatatcatactccagtttctttataataagagcccatctcattgtcagaagacgtgtctactgcaaaccagccaacacagggatatttaacacgttgattgctgttaaggctaagatgtagttaggcactgctccctctgtatataaatacaggtactgaaatagcaatcaatattatgaaggaagaaatcaaccaaccaaaacttgaattggagcaatgcctggtaccaacaggggctagaacaagaatgagagcaagatatgctttaagcatgggacatatttggaatccgaaaaaattgccatgaaagtagtaatagaggcaatacagtagggggcaggggaaggtggtgtcaagattcagatgctactggagttaggggaacactggtactaaaaaccagaccaagatccgtgagttcaaaccagaatgtagaccaacaggatacagagagccacatataccaaaaggtaaatctagacagatggccacagttccaggcagagagtcaaatactcgtacaaatagagctataggaatggtaggccataagaagacaggacagtcagaacccaaatcagcaattttgtcagcacaaacagcaacagtaacaagaaatgttgactgaagcaactgttaacttcatccaataaggttttatatcgcattttgctaagcaggaagcagcagaaagttgtgagcaaaactcagatgcaataaatggttgtggaaacatgcctgagattgagagtgaagagaagggtcgatcaaggtcatcaggcaacatatacagcaatgtatatacaacattcaaaattaccagcaggaaaagataaacactcctttggacatgagttgcttcttgagcattgcatgtaaaaaaagctgagcagttagcaagttcccaagaaccccatctttcactcttctgtgaagggcttcagagatatttcgaaagggaacctgatgaaatgcattactgctgatggagtcagcaggtttactcctgagtttcattagtgaattcttcccaatatttagcaaccacagcgtctttgaaggaggaaaggaccagcttgtctaaaaatcaaatccttcctaagggacagctggcagaaatataaggtcaaacacttttgctggtattacagaaaagtagcagaaaaccaaccttcggctagaactaatatatgcagaagaggttatgacctcaattgatctctccatttctgcaccaatgggagacagcaaataacatttactttcttcatgagtgagtggaaactagagacaatgctaacaaatttcataaccaatatttgggccaccctagtcacgacatcccaaagaagatataacagagctggaaaagatccagggaaaaacaactaagataatcaaggggaaagcttatctttccgtcaaggacagactaaaagactaaaaaggattagaatttctcagactgggaagatgaaaatgaaaagcattagtaggggaatgtgaggctaaagtcgactctggataaatataaatgtttttactgaatttcaaagaatttaattaaggccattccttgaggttaaaggatgcagattcaagagaaattaaaatgcctatatttatatagaagtcggtacatttatggaacatattattattaagacaaagctgaagtggggaataggaaaagtttgacaccattggataaactcactgccagttgatttacaatgcattattaagaagtggtcatgatgtatccgaatttttaaggtaaaatgtactaggttacctgacaaaacaaccattggtatcttcatctgggacagagttccgggctagttgccctgttggtctgacccagtgtgatatttcttatgcttttattatgacatctatactggaacatcctgcatgcatgtttgggattcctaaattcttttgacagtccagaatacagaagaacaattttctaactcattaagaaagcaagagagtcccagctcttggctctgtttggtttacccatatgggagcatgcaacataaaaaggtgaaagaaatcctaacagaatgcagcagctggttaaaggctattatattgaaattttcatgagtttgacagtaggccaaaaaactacaaaatggcagagagtagaaaaggcagttgtaacaggttgaacattgttggtgattattttttcagtggcaatgaaagctgtaatcaaataacctgaaagagatgctggcaggaataagggagccccaagggagagggaatatgaaaactgtaacaatgatgtatgctgtggacaaataaactagacaaacacgtagtttgaagtatcaaaatcaaggttcttagcctcatatgaaaagctgatgtcaggatgcaggcataaacactgcctgatttgcaaactagagcaaaagatgttaatgacttaaaatctcaagaatgagtgcacaattcaacaaccaacaggaactgtgccactggtatagaaacctcttgttatgtgggcgatccctttatcccagcattgaaaagaaaaagttacaaagcattaaaaacatagccagagaagacacctggttttgcagctgggcatctgtggtaaaaactcttgactggaagtcaagacaaacaagataaaaaagaggaaaaatgaggactggttgaagcactgtcactgtaaacgtatttttgttctttttagaccaagacggcatctcagattatgaacggcattaagctgtgcataaagtccaccgaaccttgtacatcaaattaatttggtttccatagaacattttagataatagtaatggctaataagacacaagtgccattaatcatctgcttactgacaatgttcattttataaacatgtatgttttccctatattacagtttaacattttacactcatatttgagaaattataccatccctaatttcaaagagattataattgtagagagaattgctctccataaggtttcagagatatttttgagaaattacgtaatttcctcatttcaaggaactgattatttcagaggcttttaaggtctccatactcaccttttggcaaattttcctgcctattgttctctctctcttatcatgagccaggaagcataataatcctaaattatataccaagatttgagctctttaaagaggtgtgtggtgaaattggagtgggttgatagggcatatctaaagctaattaaacagtggaaaaataaaattcctgttttttaaagtaagaatttacattatgttcattaaaataatgaattttaaaaataaagatattatcgaacaaaagctgagatcttcggtttttaagtttggacaggacaactgaatgagtcatgctcattacgtcttagagctaaaaaggatcttagatatcatctagtccaactctttattttataaattagaaaccaaggtttggctgggcatggtggctcaagcctgtaatcccagcactttgggaggccgaggcgggtggatcacctgaggtcaggagttcgagacgagcctgaccaatatggtgaaacctcgtctctactaaaaatacaaaaattagccaagcatggtggcaggtgcctgtagtctcagctactcgggagctaagacgaaagaattgcttgaacccgggaggcaggggttgcagtgagccgagatcgggccactgcactccagcctgggcaacagagtgaaactccatctcaaaaaaaaaaaaaaaaaaaaaaaaaaagaaagaaaccaagatttttataggttaagtgacttgcctaaagccatacagtcgcctaatgacagagcctctaagactagactggaggactaaaattgaagttttcttattcatagatctgtgcccttatcaataccatcaccatggtctttaggtacatgaaggagcattggacaaataggatatgtagctgctctctaattccactgagaaacagcaagagactaatacacagaagggaattacagcttttctggaatttgtctctttattattttttggacggagttcatttccattccctcacagcaatgtactgggatctcttgtagtagaagtaacatcagggagaagatgaatatatagggaaaggacaatgggaccggggagaccctagcaatccatgtgagacctctagtgagccccaaacaagtagtcatttggagaataatagcttaaaggtgtcttgaattctccagtgatcctaaaacctcatctatgaaaggagaaaaagagtctttatttcagctcataaaggaattggataaaagtgagagctttatgaattggttgaagaagtagcaggtctcaaacatcttagtcggaaataaaaatttgtgaggacaaagacactgatgtaggaaatcactgtctagagtttgaagaaaattgttccataaaatatacagtggatgtaaggtaatatacagtgcatgtctacagcaatatattatttaataaagcatgtgatttaaataggtatttaaaatgtacagttttgagtgactaatgaattaaatataacaataataaaattaaattcataaaatatgaaaactaaaaagcagaatcaaacatactaaaaaagaattttcaagttaagagatacctcatctggaaaaatgtaataagacaaatggtaaaccgtttcctaaagtatgtatttctcctgaaagagtcaaaagactaccttcactcccatttttctgagttaacaaaatagaggcataaaatcaaatttcttgaggactgtagtaatgaagatctaggactgctgttattgctttagaaccgaattaagaagaattgatggacagtgaaagaataaaaacagattcgataaaagatggcaggcggaaaaaaatgggaaaacatctaatatttttagtcagactcatggcagaagcaagttcaaagacttcggttggtatcgaggactattttatgaacccagtaaattgtaattgttgttgaggtttccaattcaaagttaaatttaagttagactctagtgcacaatggatgagagactgtgaaggtatcgtaatcactcaatatcctctctcctctctcttccacgttgacccaatgtattgtcatttatatttcatgcaaaatactacagaaggtgcttccaagcactcgtattcttttgactggcacaaatgtttccagaaaacagtatctttctgttgttaggtgacaaatactgagtgttatgtatcaagaatgaacaactaagccctacgagtcgaggactgctgctttctgccttttggaaacatgtagtattcattcacccaaaacagttgtgtacatataactgcggaaatcttctatctttgacggaagaagaaatgtgagaaaacccctaaataaaagaaattgttctcgcaaagattgactcccactatcaataaaattatctggagcttttggttctattgtgaaaaatccgccccctctgtcacaaaacacaccatatatcctgcattaaataaacttttcttaaaagtcgttccccattgcatcagcaaatttacaatggtaattttagaataagttttttatccaagcttcctcaggaaaaaaaagacacaggtattgtaggccaggctaatgtcgcattttaaaaataaactcacttgtgaatatacaggttagtcacaataaatgctcttttaaaaatgtgatacttccaacttacttgatatagtagggcactttgtttggcgagatggctctctcccagggaccctggacagacgctgaaaagaagggaggaaaaaaagaaaggcaaggaggtcaaattcatcgcaaacaggaaagacaacattaatctccagaattacaattttacactgatattggtctgtttgctcagctgcccatgaagacaggatggattaacctgctgttctgaaatttctgtcctaatctaagcgaaactgaactcattcaggcacaaagataaatgcgaagaaaaaaaaaacccacaaacatttccactgctaaacctatagaacagataagaaactgaatgagtagactgacggggtttcttgtatgtgtctcccttgagtgcttttttttataatacttcctgttgctggttctcaatattttttactatttgactgactggattttattatttcagtagctgaaatatccctctgtgatatatttacattctaagttattgaagctaaagtaatatgcttatcactctgatatggttgtttttatctttattggtttaaagagaatccaaattcacttaccaaatagatgcttaatttggtgcctcaaaatgtcagctgaccagtgtgatcttattagaaaaggtgaccaaaagtgagggaatgtctactgatatcagagcgtaataagacttttgttatgagtgatgaatcctatacgtgaaatttcatttcacatactaggaatttgttttattatgacttcactgtgtattggtcaaatgaatgatctttgcattgtttttttttttttcaggcttaagttgtaggatttcttccctaaagctgaacctctacaaatatattttatatactgtttgatctgatggttttttttctttctttaagacaaaataatcttgttgaggaggcactataacatttcctcaacaatataatcttcctcctgaatatagttttaagacactggagctttaagaaacacagaatattatcagaaacagaaataaaagacgcattcttattaatatctagcaactttatgtgtctatactttttcccctgaattttcattctgctaataatttgaagcacagctgatgctgaccattatttcctcctatgaaaaactcccttttaaattagtctcacagtaaattcactccgcagtgtattgagatgtaagaaaacgtcaaagctaatatatcctcgactacactgtataatatgaaagaacagcttctaataaaagttaacttcacccactgccagacaatttaagcgtaatgaaactccagcttctttgttttatatagagtaatagagggatcaaatcacccaacctttaaccagacatgctgttttgtaccttggagatatgtcatttaaacgatataggaaatggatttgtatttggccggtaattatgctttttcattttggcagacggaaatttttaatacagagaaaaaagacatttagctgctgttttgaagtagtctctgactttccatttctttctgtccttctttctctattcctttcttttcccttcctcctgccttccctgcttccctttccatctttgcctttctcattctcttcccaactcttctcttgtccttttttcttctgtaggatgcagctctcctgtccaaataagttcacagagtaaataagatctgatttaaaaacatgggctaaggccaggcgtggtggctcacgcctgtaatcccaacactttgggaggctgaggcaggcagatcatctgagttcaggagttcaagaccagcctggccaacatgaggaaacgctatctctactaaaaataccaaaaaaaaaaaaaaaaaaaaagccgggcatggtggcaggtgcctgtaatcccagctactcgggagactgaggcaggaaaatcacttgaacccaggaggcaaaggatgcagtgagctgaaatcgcaccactgcactccagcctgggcgacaagagcaaaactccaactgaaaaacaaacaaacaaacaaacaaaccatgggctagacttcctgacctatctggtcagagtctgttgttatggaaatattaaaaagctagccctctatagcaggaaacatggtggagagccagaaattatagctcctggctgctcagtgtaccttcttcttaaaataccagcatcataaaaggaagaagagaactccagagagctcttggtccagccctcactggctgtgaatgccaagcctgtgaatacctaaactgagaaaagaatggctattctttccttaaaggtatctatgggctgaggcctcacaatttctcttattatacctttctagtttttttttttttttatcattctagtggtccagaaattctttctaatttggaggatgctagaccatcctctgatagcagaagaatcactttggatttcctacactattcttaggcgtctctcagaaagaagtgtgctggagagggctgctggctgcctggcctggcttaggggctttcggcctgaaagaaacaacctctaagcagcgagagacagaggaaaattggcgttgcctggctgagctaatgggaagacctacgtagggtatctagagttgactttttatgtttacattaaaaggggaaaattttcaattaaatgtcagagaagttatcagaatatgcttgaactaaatagctgaaaatatttttaaagaattttaaaaatattataaattctagatcaatatgaaatttcaagcttttgtaattgcagttcttaagtgttcatttattttccttaaaaaagctttttgtcttatgtgtagccatcaaataggtccaatggtgagattcagtgtattttttttctgaaagatgtttttcccctttgattcacagtttataaattcacctaagcaactgctttgcagtcattgtttgaaaccttacaattttatgctcaaaaatgtccttgacacaataaaaaaaaaaaaaaaaaggaaaataacaacagcctcccctcattccttccctgccccatcataatcacatacacacacactggaactacttgctttagaaataacacacaattggatgatagttctacggaattgggttcagtgctccttctcaagagattcttaagggttgtcgacaatttcatttggggctgccagatgattctggtcttccatctattcaaaagttgatcaaatatgtggcagtgctcacaagtgtgccacagaattttttcatttcttgtagcagtactgatgccaacaacagctgtttcttatctcagtgtaccagtggaagcttgtcattcttcataaagctagcctacgtaatagacacacacatcttttatgcctgatgtgtccatttttagtagcccatcaaaagcaaatttatcggcaaatagtttctatatgacaccgggttgtcctttggtattttcttatacagatgtgcttataaccactacgtgtaattccagggcagctttgtgattcagattcttgaatgtacaaatcaaccattatcatacggcaccagcatcatggggtattgtccactgaatttagatagcaaactacacatgcatttatttattgcaaaaccaacctctgaatttccttttgtgttacagacacagtatgttattaagagcaagaaagggtagcaattctatcttcaaatgcttttccttccttgaggtgacaggattcaatattgtgcccaaggtagttttgaaaatcacaagcacaggccacattatttaggggaagttgttatttcagccgtttttaaatgcatgatgaacagaatgttccaagtgatgcaccctggtgttaagtcatattttaatcaacataggggcctaaccagaaaattaaaaagaatgctaatgttattttaagacatgccaaaagagcactttctggaattccaacacaaataccttcattcatctctctacttttctcatacttggtggatttggagtttgataacataggtgggtcaaaaaagtggggacagtttagataaataaccgatacagcaatcactggaggtaaaatagaaaactcacctctggggttgaacaaaaggcattagggaggatctactagacttgttttgtcttttccagaatgtcatataaatacagtatgtaaccttttgatactggtttatttcactcagcataatgcataatccatattgctgtatcaacgatttgtttcttttcattgctaagtagtatgccattatatgggtgtactacagcttagttatccattcacctgttcaaagacattaggttgcttttagcatttggcaatcatgaataaagctggtatcaacatttgtgtacaggtgtttgcataagcataagttttcatttctctaagatgaatgcttaagagtgggcttgtagggttacaacagatttttcattgctaaaaaattcccacttatggatgtaccatgatttattgaataaattccctctttgggaacatataagttgtctccagtttttcactgttctaagtaaggccacagtgaacatctttgtagataaatctttgcacatattttagttacttttttaaagcaaaattcctagaagtatatttacttgattaaaggctatgaatgttttaaaaacattttacataaattacacttatggcagcagaagcctctctttattgatataagtgtaaagagaaaaatcaattttctgcaggtcaatagtatttagttggcataattctcaaagcaagttagatatactgcttgatacagtagattatttgggaacattcctctcacactctcctcttcccctgatagactgtaaaactcagagtttagaaaggcactcaggatgttggctttctatttcaaagcccaatccagcatcttgagagggagctggatatagcagaaaatgtccagagtacagattcagaagaactggatttgagtcctgactcccctatcacttcatgatcttaagctagtctttttcctgcctaagccttattttccttatattccaatgggaataatgatatctccctcaccaaaatgttgtcaggataaaatgaggaaatcaatatgaaattgctttgtaaaatgttaatcaccacacaaataatgtttgtaatcacatagctatgatgtgttgtctgaatgatggttaattgtggaaccaattctttctctctcacctgggcagcatttatctgcagccttgaatccactcctaactactgttaatgtgccacatgtagtataaagtatggcagagagaaatgcctttgaatagtatctaactgcctgggcttatggtacttctttctacatctctgtcttcctagaccaatgacatctatacaacagatctttcattcttagctagaccatttatccaccattcatcagcatgaatgataaacagattagtctatattttatgcagtgaaaatcagaggcccatagactgattagcatttggcaatcatgaataaagctggtatcaacatttgtgtacaggtatttgcatcagcataagtttggttcttttcactgaaatgcaagtgaaaggacaagaccataagtactagaatcatagcagatgctatgagaatggctggactctttaaggaaggaagatcgtacaaagagaactgcatgtatacaccacattttcatacaatggaataccattcagcattaaaaaaaagaaggttcctaccattggtgacaatgtggatgggccttgcagacatgctcagtgaaataagccagtcatagaaggataaatgctgtatgactccacttttatgaagtgtctgaaatagtcaacctcatagaagcagtaaatagaaaagtggttgccagaagacagggcaggggaaacgagaaattgttattcaatgagtataaagtttcacttatgcaagatgagtaagttctagagatctgctgtacaacatagtgcctatagttaacaatactgtgtagtgcacttaaaacttaaggggattaagagggtccacctcggccgggcgcggtggctcacccctgtaatcccagcactttgggaggccaaggtgagcagatcacgaggtcaagagatcgagaccatcctggccgatgtggtgaaaccccatctctactaaaaatacaaaaattagctgggcgaggtggcgcgcacctatagtcccagctactcgggaggctgaggcaggagaatcgcttgaacctgggaggtggaggttgcagtcagctgagatcgtgccactgcactccagcctggcgacagagcaagattccatctcaaaaaaaaaaaaaaaaaaaaaaaaaaaaaagagggtccatctcatgttgtgttcttgccatgcacagacacacacaaaagcaaagggacacaaaacttttgtaggtaatgaatatgttcgttatctttagtttgactgtggcaatagtatcttgggtgtatacatatgtccaaacttaccaaattacatatattaaatatgcatatttttgcatataattataccccaagaaagctataaaagtacaaaaaaaaaaaaagatgagtacagtggaggaaaacaaaagggaatgtaccctggcaaatgcccccaaatggcggtggcagtagaactgctgtcaaagaaaaataatacagaagctagaataaagtgggatgaaacacaagaacagcctagctggtgaagtataagcaattcttgagcctgacagactaagggtgtagaagaagaagatgtatttgatcccacgatcactggtgacctcaaaagggcaatttcacactagtgatcagaggctgaaggagggagtagacggaggggaagcaagcatttgagaagttgtgtataaaaagaggaaaacagaaatggaaaggggcaacatctgattgttggtcatccctctcttgtgctctgtaacccagcctattcagttcacttcattactgaatttgcttagggtttctttataacgttaaattatatgcaaaatgtatttctatcgttttcatttcctaaagtcataatcaggattataatacagtatttaagctttcatgtagttattagtgttgaatatatatgtatatatgtgtaatttttcccattccaatttttttctgtatgatttctattttcttttgatgtgacgcatatagttcctgtagcaagagtaagttttctgtcatttaaatgaaaggccaagttaaatttaacacttttcaaaacgttaaattaaaataaggatagtgctttatatgtctatatcgtatatcaaaagtaaagattcaatgaaaactttaagatcacttactaaactttcaaagatgggcagactttccataaagatttcaacagcagagacagatgggctacattccagagaggaaggtcacaagagtgatgaatgagacctctaatgtctgccatagctgtgaaaatctttatggctaactaaaattcctaacgaataacaacctgtaaatattatatgagctgtcagacagataatgctgagctctgagaccattgcacatggtgaacagaataccacaccatgggatttgtcagtagattgccaagtcatttagagtatcaggctcacatttgatctgggaagtcaagagttcatactaaaattcttggcaaggtgactgagttgcagagataaaactatatctaatatccagtgctgatggctgcacagtcacacaaagtctaatagccaaagttgggcggcattactcatgaaaaaaaaaaagaaaaaaaagctgcttctaaccgacttatagaaaacttcaaaaacatcacggtgattattagaagagtaagaaagcaatcaagcttcctaaggtcagatataggaagatagatacctacataaatagagccatgaataatttatgctcaaggaattttcgagtaaattcgaacataattggctgactgcattaccagggaactttcctccaggtaatggtggttacagtctttgggccatctgggttaagtcaggttactaacaagtcaatgcaatatcgccaggtgcctttactgtctctgcagatgtacttttaaaagacgacaggcagtccacaccatttgctgaacgctctctgtgtgaaaggtattgtattaggcaccagggaaatttcaaggaaagtaaaatttgaaacctgagacagtagggagcaactcagatattaaaaaccaaatgatcatagatgggatgtacatccattagaaagcgagaagagtgagaaagaactagcaattaacgcaaaaagagtataggagagattgaatttggggcccatttttcactcagttgtgaaagaactaaacatgtataccttagccatggcctcatggtgagcgcagtgtgcttcctagctccttgaccttggcttgcttgaccatgtgacttgctttagcagatatgatgtgaacagaggcttgtcacactggcaatctgccatgagaacatgccccaggttgcttctgatcctttagtctggggctcacaacccaacacatttagaaaccatctaaactgaactcacagcctagaggcgaacccaggcatgcttcagtatgaagtagagctttccagtcaagttttatccagatcacccgaattacagttgacctgtagacccataagcatgagaacagaagctttatattcttgtatagtagttatattgtggcattattgtggatacagctgacagagagaggagtagagagagaaggggagaggggaaacagtatcataaagattaaagaataaaaaatatcctccagccaaagtctctcccatttgttactagccactgcctctactaacatgcaaagattaatggggattatcatcctctttggtctgtgcagttgagacgtgtgggttgctattcactggtgtctggaaccccttttctaaggctgataatccataatagttacaagtatgaacttgaatatgttagtaaattgttctagtctcagttttctcttctgtgaaatggagacaataacagtccttattttaaaggttggtgtgaggattaaacgggttaatctatgcaaaatgcttcctctgtgttaagagcacagagcgctcgatactttttaaaaattccaactcctacgtttataattattttcatcattaatgtagctagttatcaggatatttatctcattcacgaacttactgccaatgtgaggaatcccagggtaaccaggaaagtgacagagactttccatggttctagagttaaactgactgttaaccaccaaagcatgggaccagggaactagttaaggaaataatctttcttcctctttttctagccattttctgactctttaaaaaatgttacgcggttctcagagtaataaaacatgaacggagacaaatcttcctcttggcattctgatgctgatgtttactatgaaaatcaactgtgttttatcattatatactatattagtattgcttcagaattcaaaataaatagctaaatatttttagaaataaataaaacattcttgtttaatttcaattgttggttctgatttttaaactaaatttttacataaccaagcttactattttttttcctatttaaattggtgtgggtgattcatgttaatggaattctctgacctgaagttatgtgctgtcttgtttaagacataagccttgctgcccccgccttttttttttttttttttttttttttgcctgaagataacaaggttgtcatgagcttttgtgttgggttccaggaataactgaagatgcagttcaaaactgaatcttcctctaatagatgtatctgctccagatctcctggaccaagtcttttgaattactttctttcccttgatagctggtctaggtcgaattctataacatgaactccttcacttttcacctcctgagaataaatcccttctgtccctaactcacaccataaatgagctcatttcattccattcctcttcgattttttttttccacagacatttcctgctcagactttttctttccctatcaaattgccctcatgttgactaatccttcaattattctctctcgtctgcctatttctatctcattaaaacattagtgctctctaaaacctatatttatattcattatacatacgtaagaaatcccttttctgaacagaagggcggtaaggagactacacacgaaactggaaagggagatattcatctttttttttttttttggatacagagtcttgctccgtcacccaggctggagcgcaatggcgcgatctcggctcactgcaacctccgcctcctgggttcaagcaattctcctgcctcagcctcccaagtagctgggattacaggtgcctgtcaccatgcccagctaacttttgtatttttcagtagagacggggtttcaccatgttggtcaggctggtcttgaactcctgacctcaggtgatccacccaccttggcctcccaaagtgctgggatcacaggcgtgagccaccgcgcccggcccgagatattcatcttatcagaatggctaagtagaagggagaaactgatttttcatcactgaatgcatcttgtgactcttgctaggtgagatcagggaccaagcaattataaacattctttgctaagttcctatcaaaaggaataccctctactttggatttgcatgtagcctcagggacaatatgcgttaatactcaactagatagaacatctcctttctctcactgtggaatggattcctcccttccattctactcccattgcacccactatttactaccactgtaggaggtcattttttataggtctgtcttttgtgattggtatttaaatgtcccaaggcaataattctctttttatcttcatatttcaggtgactcgtttttgttaataaatataggaatgaatgaatgaatactacaggcacagtaagtaacaatgctacaggcaccatgtcacttcttagctcagaattctatgacttcccttctcacaaagcatatatgccaaaggcttttaacgatagccaaccatagttgataagacccttcctcgtctggcccttggtcactcactgacctcctatcattcaccatctttcttccttggcttcagtcatactggcttccttgctattaatatttctcaaaccctctaagcatgctccatcttggatcctttacttttactgtttcctccacctggaacactttgtcccccaatatctgactggtgtacttcctcacatctctactgaaatgtcaccattcctgaccactccactaaaagggtccccttctcccatcctctagcccctttagcctgctttattctttgtttttaaatcaaacttatcatgacctgattgtccatcttctcttgttaaaatgtaagctccacaataaataaactttgttttatttactgccgtttccccagttcctagatcagagtttgatttacattggtcattcaacagacatttgttgagtaacaaagtgaatcaattcttaactgactgaagataaagtgaagttcattaactctttctggacattagactaagcaccaggctaagttctttcattttattagactgggaacaatcttttaagtgcccagttattcattcaatcaaggcatatcctgcatctaatatgcaagatgttgtgttagatgcaaaattatttttaataaaaaagtaatgcaggccctatgcccttaaagtgctcacactccaacatatttcctttcaagatctatgttactgaccatcttacgttctaactcttgcctgtcatgggcatgtatgctgctgagcttaaggtttaaggtaagagattcatgtaattttatgctgtccccaaagtccttacctattaatggagatcatgaggttggacaccttaaataataataatcactacttatcctgaacaaaataatcaacctcattatgaaagcaagagtaaatcaaattacccagtgactgtaatgggcctattataatacctttttcttagatgcttctaaatgcctgtcaatttcattgccccctcacagattggcttcctccaggaagccaactctaaggcaatgattagagagcaggatagacaactgtggaagggaagtgaaagaaacaggaatagaaatagggagaagtcaaggtgaatgcagacccagtgacagtctcattcaaccccatgggagctcttgagctagaatgttaatgttctcctgagttgggccaaaatggccaggtcattattcccctacactgatcaggaagagctgcccctgtaaggggtatgatcttgggtgaggcagctgatgcaattcctgaagattgtctgctgaggacactccctttcatcgagagactaaagggtccctaaggatgcagaaaagcaacttcaaataattcctcaggcataggtcactgtatttagtgttccacatgactttcattaccacaaattgtgcaggcattggtataaaggagtgattctcaactaggggcaatttcacccaacaggggacatcagacagacaatgtctggagacatttttggttgtcacagctaagggaggggagtgctactggcatgtagtgagtagaggccagagataatgcacaggacagcccccaataatttttgcccacagaggtgtgatcccaccatttctgttgcgcaaagctttgtattctaggacagatgacaaaatgctaccccaggccaaactcacaaatgccttcattttctgagtagtgtaaaaatacacttttcagagccagcattccactaattatctggccccaaatgccaatagtgcccaggtcaagaaagcctagtttacagtctggcctgtggcctgtgagatggcattacccttagatggataataaataactaatccaatcagatgctttgtcttggagagcttgaatgtaatacacagagataaacagagatgacagatgggtggggaagtttaaaaagtcggataacaaaggaagaaaatggaagtcataagaaagtagaaactataagtagaaggtgttaggtggagagaagagagaagatatgatactgtaatagtctgaagtctatggcagcaaatgcatatacagaaagaagcaaacatgtttcgtggtgtctgttgttccatgttattcttttctttctttctttttttttttttttgagatggagtctcgccctgttgcctaggctggtgtgcaatggtgtgatcttggctcactgcaacctccgtctcctgggttcaagcgattctcctgcctcagcctcctgagtagctgggattacaggtgtgcgccaccatgcctggctaattttttgtgtctttagtagagacagggtttcaccatgttggccaggttggtctccaactcctgacctcgtgatccgcccgcctcagcctcccaaagtgctgggattataggtgtgagccaccgcgcccggcccatgttattcttcatgcctctctgtatcctgaaaatgttccttatcacctaagcctatccctgtcccttacagccttaaggagacatagcacataacagagcagtacctgcagtcgcctgaaatcaagatgatttttactgcagatatctgaaagtctatttaaaaatctagaatggtttttaaaccaggaacagtttatgtaagtctactaaagaacaaaatgccttttgtcctcacttcaaagttctcaccagaaagtactttgtaatcccaaactggttgtgttctgaaaatggaaaacatccaaatggaaaaacgaaagtaatgattcttgcccacagggatgtgatcccactatttctgttgtgcaaagctttgtattttggacagatgacaaaatgctaccccaggccaaattcacaaatgccttcattttctgggtagtgtaaaaatacacccttcagagccagcattccaccaaaatagtgcccatgttataaaactgattcagaactctggtgctggtctcttggccctagctcctcatgaggcccagaagaatctgtcacaatgaggaagatgaaataagaaagaaacagacatttgtctcatctcttccatgccaccgggctaatttccatgtaagtccgtgacgaaggagtggtggttagtgatccagctaaatgcgcccattcagctctaaagccagattatgcatggggtatgatagcagcttcataaagtctaggagaggttaatactattgttgttccactcagatcccttttactgagctggttcacccagccgcagttgttgtgagtgttggttgctaaggcctcattggtcctttcaccagaaatcctcccttggccaaatgggaactgctttgctatctcctactccccagaaatccacagccaatgactaattcacacgggaaaataaaagcccagccctggctgggcgcggtggctcacgcctgtaatcccagcacttttggagaccgaggcaggcggatcaggagatcaggagttcgagaccagcctggccaacctagtgaaaccccgtctctagtaaaaatacaaaaaaaaaaaaaaaaaaaaaaatccaggcgcggtagtcccagctactcgggaggctgaggcaggagaatagcttgaacctgggaggcggaggttgcagtgagccaagatcacgccattgcactccagtttgggtgacagaacaagactccatctcaaaacaaacaaacaaaaagcccaggccccttatctcaaagtagggacaatttgttctccagagctccctgtgggatcaagctgaagtgagtctcttccttcccacttaactccttgaccagcatccttcttactttatcctgcttccctcactccctttcacctgaacaaattacttctacaagaagccccatctatctaaatagggctctacttctagggattttacctaaggctagggtgagcaactatcttggtttgcctgggactacagagatttcctggaaaatgggaattccagtgctaaatccgggaaagtcccagacaaaccaggatgagtggtcactctgcaacgcacataaatatttggatcctgagcatccttcctgctaagtttatgaagattctttgcctacagggacttgagtgatccaaataacatagataaattagtcatttctgggaaaccatctatgcacaaaaaaaaaaaaaaaaaaaaaacaaagtgccccaatttgtagtatttgccaatttccatggagtaaatcttcccactatgcctgatttcaagctaccaaaggtaggcttaataactagctcacaattcctgtatattttacaattggctctcttgagccattgtaagccagccccagcacagaaattcccatagcagaaacaaaaacgttctgtttcctcatgtgttcaaattgatgggatatatagggccaacgatgcaaaatctggttgctaatgatactgtaaagcaaataaatctgagagcttattggggagtatacatttgagctaaaggagaaaagggccatgacaacacattttaagaagagaatataattattactgctgtagctgctttttatgggcattggaaaggctgtctttgaatttataggggcattatcagcatcactggtaggtcacatggcatttgtcccaaattcctaacacttgggacaacatgtgactgctgaagaaactggctcaaatcatttcaccctgagattttacttgaaagagaattttagcctgcaaatcatctcacattggacctgcaaaattctttctgacttttatcatgatggcttattttgatgtttttatttttttgagatgcagtttcactcttgttgcccaggctggagtgcaatggcgcaatctcggctcactgcaacctctgcctcctgggttcaagtgattctcctgcctcagcctctcgagtagctgggattacagatgcatgccaccacgcccagctaattttgtatttttagtagagacagggtttctccatgttggtcaggctggtcttgaactcctgacctcaggtgatctgcccgcctcggcctcccaaagtgctgggattactggcgtgagccaccgcacccggcctcatgatggcttatttaagccaatctgaagctttaaattattgccccactcatatttcaaattgtctgtcccctgaggacactggtagcataggttggagcactgttaagtgaaatgtcagcaattattagatgtgcttaaaggtttcccctattttttaaaattaagtgtgtatgtgtagtggggaatgtccaggatgaaagcttggcaactctcaagatagaaacaaactgctaggccctatgtatcaaggagaaactgtaaaagcttgagtcactttgacaagagagaaaaagacttaaccagggatatgattaaggcagttaagattgtaaagcctgcaagaaataatggatcagttatttctttttacagtgtctcataatctgagaaggtcactcaatgaaacagcttttaaattcagaataaatagtaaaaaggaaatttgtctttcagagtcccattgccactgcaagaggtcactggttaaaagctggagtataaaatgttacctttattgttttttttccattacaaaggtagtacatgctattaccagaaaatttgtaaaagtaaaaagaaagaaatgatgcaataactgtttgtcttttggtatctttttattttccatttttcctttatgtgtacatttctgttatttttattttattttgtaatatagttgtgatcatgctgtaattttgaagtcagccttttcccttaatgtattacatggtacagtcgactttgataaaaacgaccatataaagttatgaatgctattagtctttgctgagaagcaacagaaaaggtcacattatttattgagtgtctactatgtgatagccactatgctaaatctcatgcctctgtgtattatcaatgtcaagagtgaatttacctcttcttcttttgggtataagacataattcattctgtaaatatttactgaacatctaccaagtaccacataccacattaggtactgtagaatataactgtcaacaagactaatactatcctgacattttagagattaaggtctatctttttgattatttatcactcgttagttatacaaacaactattgagccgttctaatgtgcaaaacactggactttcagattagatccttggaaatcatcttcagaaaggagaggaactacttatactgaccattaaatgcaagagaatgaatgaaactttcatgactagtttgactctaacaggcatgcattaagttatactatcaagctgatagtaataatgatactaatgctaaagctaatagcaaacacttgaatagcacttactatgttccaggcactactctaagggttttacaaatattaactgtttgatcttcactgtaaccctatgaaataatacagccatatttcaccgaattcaatatcccattggtcgtatggtgcattctgatttcagaactgttgaaacgtgggtggaaaagtgtgtcttacaattgaccaaatatgttactattatccctattttaaagatgaagaataaagagaaagaaaaaagcataaagtgtctgagtcaatatttgaacccagtcagtttcattttacagcttttactcttaaccgctatcgataccattttgataaggcagtttttagcccagaggtgttgagagaaaaatttaggttatgtaaatcaacttaggatggccaaacgaagaggaatatacgagagaataatcgttggcaatagcagatagactagacagttattggcctgggcatttcttcttaacgggtaaggcagtgtgatgtgtggcttggatgtccagaaactgggttccagtcccagtattataactatctttgtgaccttggttatgtcatttgatcgttctgcacctatttcattatctgtaaaataaggaaagggctcgaatgattcaatgtttctcaaactatttcgactgcaacccacagaagaaaaacgttttacactgtgatctggcgtgcgcgcgtgcgtgcgcgcgcgcacacacacacacacacacacacacacacgcatgtacacacatatctaacaaattaaccaccgccaaaacaacacttaaccttgcttaggtaatgcactctgatattttctaatctgttccattccattccattccataccagtcaaaaattgttggttgtaagtcattaaactgattttaggatttgctaatgagccacacctcagagtttggaaactactggtatagatactttctaagcttatctccagttaggaaactccacagcacaagagggctcctgggtgggagtggggctgggaacttcagtaaagagagggacttgacccttttgcctcataaatactcattttctttttaattggatcacgtttctacaacctttagcagaaattttttgtcattaaagcatctggcaaataccacattaaggcaaagattcactgtgatccatggcataaagtttagtgtgaaattaactggtgtgcctgaaaaaggcttccacagtcacctaaaactggagaactatagactccttatcctcttagagtctcagtgtataataaaaattccaagaattctaacaagaaataaacttgcttatctttgaaacctagtgtttttccaatcttattaatcagtactatttttttcaagggacagttatcaaaacctaatataacattaatgttttaaagaacctggcttggaaaatattcttttaagggacctctggaacttgtaaaatattaagaaaaccatggattctttttactgttatagaatgatttctccctttacccaaatatatagtgatctttcttggtgagaaaagtagaatttagaacagaagaccagagaattgaaataatggtcaggaaaaatctttaaattctttttttgagacagagtctctctctatcacccaggctggactgcagtggcatgatctcagctcactgcaacctccacctccagggttcaagccattctcctgcctcagcctcctaagcagctgggattacaggcgagtgccaccacgcccagctaatttttgtatttttagtacagatgggggtttcaccaggttggccaggctggtcttgaactcctgacctcaagtgatctgcccacctcagcctcccaaagtgatgggattacaggtgtgagccaccacgcccaacaaatctttaaactcttcaaaagaaaaggacaattttcagactactatgccaaccaatgaatactttagtactttcttaatcacagacatatgaagagactgacaatatacctaccaattatacatatataactataaattagtatataatttaaataatttaaatgataattttattgtaaattatatacatatttgaagtcacactattagaatttctcctttttcttggtttaagttgtagaagtcaattaggagtagcagtgtattaaaactagaagtaaggacaagttagtgtctatcagcggagaagggtcatatttcacaatgcttttctcttctcattttctcttagatctaagataaaagaaaaaatttctttaacatgtagagattgggccaccaggaagaaacagtgaattcttttttttagtaaaaggctgcctctgtcttctgataaacaacagacagctggtaatgtaatttccaaataatttccaaaggggagtgtgtgtgtgtgtgtgtgtgtgtgtgtgtgtgtgtgagagagagagagagagagagtgcacacacgtgcgagacagagagagagagagaataagataaacagagacagtaagcatgtttacgctggcgggtgcaattagtagttcctccttatttttcttttctttgtaatttctaagctttaggagccaccctattattatttatagtaacctgaaagcacattactaaacatgtatcaactcaggcctgtctaaaaaaaagtatcaattcaaattcatttaatatgaccttagaggaatatttaaaacatatttttattcattggtggggggaagctgcttttatagtagcaaatacgtgacttcagagatgtcctgcttcaaatatggtgattttttttttttttttaaatttagggtcagggtcttgctctgtcacacagattggagtgcgggggggggtggattatggatcactgcagccttgacctcttgggctcaagtgatcctcctgcctcagtttcccaaagaattgggattataggcatgagccacaccatgcctagctcaaatacggtttggatggcacacccaatttctggtgcaattttctagaggtaagtttggcaatacacttgaaaaggcttacgaatgtaaacattctttaacatgacaattccacctttaggcatttatcctgtagaaagaatctgagatatttgtaaaggtataaaaaggatattagccataatgctcgatataataaagattgtgaaataatctttatattgagcaatttagaattgtgttggtaaatttggtacagccacagaagagagtattagccagtcattagaaaaattactctgaagaagaatatttaaacacacgaaaatattggaaagatagttttaagggaaaaaagcagctcataaaactgtagcatgtttttatctgcgcatggtttaaaagaaaagagagaggccgggcgtggtggctcatgcctgtaatctcaacactttgggaggcctcagtgggtggattacttgaggccacaagttcgagaccagcctggccaacatagtgaaaccccgtctctactaaaaatacaaaaaattagccaagcgtggtggcgtattcctgtaatcccagctactcgggaggctgagtcatgagaatcgctagaacccaggacgggggaggttgcagtgagctgagattgcactctgtctcaaaaaacaaaaaaataaaaaaataaaagatagaaccttgatacacacacacacacacacacgcaaccacaagagaaatacagaaagtatataaaccaaatttctgatagtgattatctctgagtcataggattatggatactttttcttttcttgtttgtactgtgggctttccaaatttttcttgatgtgtatagagtacctttgtaattttaaaaagtacaatgtaaagaaacaatccatccttagtctcaccgtcctatttcttaaatatcccttaaaccaagttggtattttctttatacctgcaagcaaagcttttaagcgtatattgatattccacatgggcatccaagagactgatgacttccggggctggctccattcaggcaggtagatcagtctctttatgaatacctgtgtctaacaggcctgacctttctggaagtgggcactgatgtgatatggtttgaaaggtgtgagaatgctccccttggcccctcaaagttccttcctcacagctcagagcttatggccgatgttctaccacctcaggcttatggattttcacactaataaaatgcaaataacccaggagaagtacacattaaactttacctatcacttgggttaaatgagtatatcattttctgaaaataggttttaatgggtaagacatgggaattcagagggggagtcagggagaagaaaatatgaatgaatatacctggtgtctgaggagtaattaatattcataatagtactattttttatttatggtttatgagtcgcttaggagtatgttatcacatttaatctcaattaaatcgaatagaatggctgtcaccaaggcaagttaagtagaccagagatttggaaagatgcagaagacgaaatctgtagcctttatcatttttctagagccgttcctaaaagccacgatcccactcatttagataaactgctttaacttatccctttttcttggcaactccaaagcattgtgaaactgtgtccaaataactagaccacatgcggataataaagttagagccagtccagaaaataagatacttcttcttaatctattatcgatgtatgacaaaaacacaggaccaacaccttccaggaaattttgttcaaaaagacaacagccaactggagacacacatgacaacatctactcaaatactttaaagtatttgtgagcgtggatctttttattaacccgtggagaatggaaaagaaaggaaatgatcagaaaatggcaatgaaagaatatggcagaagaatggagatcatacagaattacttcctctctataaaatatataaattaagtaaaattacagtgcgatgcttaaaaacacagactctggagccaacttcttgagtttcaatcctggctccctcatctactagctgtatgaatgtgtgcctcagtttcttcatcattgaaatgggtataataatggtacctaccttaagggattgaagggattgctataaggattaaactagttaaaatctgtaacatttctaggcacaaagtaattgcgttaaaatgatggataaaccctcatatatactcatatatgaccacaaggaaatacatcagaatgctaacagatgttaactccatgtggtaaagtatggctttttaaataccaaaaaactcaacacatatacttttataatcaaataaaaagtggtataaattaacattaatcagaggaaaacaggtgcttgccaatttaatatgcaatattgtataaataggattttctaatacttaaactttcagttaaccaaggttatttctcttagtattaattataaaaacataattaataaaatagcaaaaccagtaaataaaaagaatggctagaggtcaagaacaaaaggagaatacaaggctcacgaatgtaatcctagcactttgggaggccaaggcgagtggatcacttgaggtcaggagctcgagaccagcctgaccaatgtggtgaagcctcgtctctactaaaaaaatacaaaaattatctgggcctggtggtgtacacctgtagtcccagctactcgggaggctgaggcaggagaatagtttgaacccgggaggcggaggttgcagtgagccaagatcacgccactgcactcacagcctgggtgacagaatgaggctccctctcaaaaaaaaaaaaaaaaaaaaaaaaaaaaaaaaaaaggaaggatgcaaacagttagggaaaggaaatgcccataggctgaggtttcaacttggaggcatagtatttatttattattgatatataatattttacatatttatgaggtaatgtgatattttactggcatagaatgcataatgatcaagtcagggtatttgaggcatccattactttgagtatttgtcatttgtctatgtattgggaacaattcaagccctttcttcttggtactttgaaatatacaacacatcgttgttaactacagtcactctattctgctgtcaaatgatataacgtagtccttctatctaactggatgtttgtacccattaaccaccctctctttatctccccctctacccacacacctttcccagccactagtatctatcattctattctatgtttattatcaatttttttagctcccacaagagtaagaacatgcgatttttgtctttctgtgccagggttatttcacttaacataatgacctccagttccatccatgttgctgtgaatgacatggtttcattcttgcagtgtttcattgtgtacagataccacatattctttatccattcatctgttgatatacacttaggttgatttcacatctttgctgttttaaacagtgctgtgataagcatgcaagtgcaggtacccttttgatatactgatttcttagctttgggatggataaccagtagtgggattgccagatggtaaggtagttctatttacagtttgttgagaatcttcatactgttactaatttactgttacattttcatcaacactgtaaaagagttccctttcttcacattctcaccagaatctgttattttttgtcttttgaataatagccattctaattggggtaagacgatatatcatgtggtcttgatttgcatttccctggtgattagtgatgttgagcattttttcatatacctgttggccatttgtatgccttcttttgagaattgtcactcatttcataaggcagggatcatttaatgaattatttaaagaattatagagtcacagtaacatatattggatgatcatattataattacatgatatcataattattagctttatgaactgaactgataggcagaaattaaaaactcaaaagtatgtttttgcttcagcagcccatatactaacattggaataatgatacagagaatactagcatggctcctgagcaaagtgttccacatttttcaaaaagactcaaaaatattaatatggttaacatttgagaatatagtgcaggaaacaattatgcattagctgaagactggacaaaatgatccaattggccttcctcttcctaaccttctcaacttatcaaccaagttatatttcaggatgatttatgcttctactgcatctgataaaagattactataattcaactcttaattcttttgttttttcaactgttattcttattaatcaagatgcaataaagttaagtgataaaagctgaaaatgacttactggaaagaaagtgctgagatgctggaccaaagtccctgtgggcttcatgcagctgcctgactcggtcctcgacggccacctgggaggaaaaggagagaaatgatgttctctcattctatataatgaggaacaattaaaacaatgtatcctttctgataagatactttgagtctccaagactgagaacactaaagcaacatttcataactctagttttaatattcacttaccgtatatagtattccagactcgtttttatcaatccaaggccaaacacaaaggatttcctctctcgacaatgttaaaatgagattttggtttttttttacagtcaactcattggcagccacaaatgaactactgcttcaattagtaccataaaaaaatacaaatctttactttcacaaaaacattagggagggtgacatttggtataggtgactacagaatctcagaaatgacatgtcttgtctttaagtcttaggctattgtttttgacaaatttttaaagaagcaatattgattaatagataataaatcattgagtgatatttaattattgataattattaattaaccagtggttgattaatatttaattatgggctgggcacagtgactcatgcctgtaatcccagcactttgggaggccaagttggctggatcacttgaggtcataagttcgaggccagcctggccaacatggtgaaaacccgtctctactagaaatacaaaaattagtcaggtgtggtggcgcatgcctgtagtcccagctcctagggaggctgaggcaggagggaggctgcagtgagcagagatcacgccactgtactccagcctgggtgacagagtgaaactccacctcaaagaaaaaaatattaagtatcaaagaagtacaggcaaggcttaaatttgggataaaatagggtgggtagtaagataaaactaattttcggaattcagttttcagtggacttggaaattattaagaaatatacctttagggggcatgcagtgaaaactgccattcttttcttcctattaggtttttctataatatattgacacagtgtgctgtcaacttagtgagttctattcttggtggggaagaaaggaataattttacgggtgacatgctatacttacttatttggcattttgccaatccaatataagtggtggctccaggcatcctagctctctaactctggattttgatttagttgtgaacagtccatgctaaactaggggttgatcagagcttgcacagagcaatcagaactcagggggtagttcccgtggtgtgcagaattcccgagaggtaaaaatcgatgttaatctcatcagaaaagtggctcaggtagcctggtctcaaaccaactctggccttccaatatcaattaagtgcctagtgtatatccagaacaatctcattttttcactctctccctagacttgcccatttttgcttggcccaaatacgtggataaccaagtggggttcccctacaatgcaggatttactttattttatatacacaaaagcatgagggacatatcaaacctaccttcccaaccttatgaccctgcactcccaaactctacctgctaagcccaccaaaactacctgcctgtcctgcactattccatccaatataactcttgtgcgtggcttcttcatgctgctccttctctcggcaatgctcttaccccacttctctcccagatcaatgctgttagtgtttatatgtttacttcctcatctcccaggttagaattaatggcttcctcagcattctaacagtatatggtttatacctgaagcacttctatcatataattcattttagttatatggacatgagtgtgtcttgcaatagattggaaacttcttgatagcagggaccattttttgtttacctttctcttcgaatgtctccaaccctttctgcaggaggcacatagtatatggtagcaaatatttgtttaatgactagttgaccaaacaaatggatgagtaaatgagtaaatgtggtacgtgtgtgtgtgtgtgtgtgtgtgtgtgtgtgtgtgtgtgtgagagagagagagagagagagagagagaagagaagagaagcgatgcggaacaaacaagtatgcctactgacactgagtgcactgactgcaggtctgtaatggttaattctatgtgtcaagttgactggactatggggtgcccaggtaaaccactatttctgggtgtgtctgtgagggtgttttgcagacaagattagcatttggttcagtggattcagtagattgccctccccaatgtgggcgggcatcatcctgtcagttgaggtcctaaacagaacaaaaaggcatgttccttttttccctgcaggcctgcttgagctgggatgtcagtcttctcctgcacttgcactgggatttacatcatcaactcccctggttctcaggccttcagactgggactgaaatcacactaccaattttcctggctctctagcttgcagatagcaggtcatgggacttcttagtctccaactgcatgagataatacttaattttatatattcacacacacatagacatacatatatacacacacacacacacacacatatacatacatacatacatatgtatattgttgcttctatttctctggagaaccttgactaatcaatgtccctgggtaaattattcttaactttccttatcagtaaaatgtggaaaataatataacttatagggttttgtgggaattaaataagatgatacaatgtaaagcatttagcctagtttctgtcacgtggtaattgctcaataaatgttaccagctactgttcttgctactattatggttaataaaaggagaggaataggccaggcatggtgactcacacctgtaatcccagcactttgggaggccgaggcaggcggatcacttgaggtcaggagttcgagaccggtctggccaacatgatgaaacgcagtctctactaaaaatacaaaaattagcttggtgtggtggtgggcatctgtaatcccagctactcgggaagctgagacaggagaatcacttgaatctgagaggtggaggttgcagtgcgccgagatcgtgtcactacactccagcctaggtaacagaacaagactccatctcaaaaaaaaaaaaaaaaaaagcaaaaaaggagagcaatagactataatgtgcagggcaccacatacaatacaaaaatggctaatgtttattaagcaatatgtggcatgacaatatgaattatgttatttcatcttcacagtaactctgcaataggagttaatattattccccccgacttcattgacataaaaactgaggcatgagaggttaaaaaaaaaaaacttgcctaagcttcagtagttagtaaattggcagagctaggattcaaactcattcagtctgggtcttgctcttaactgctatcctgaagattaaagttgaaaaaaagtattttataaatatttaataagtaattggctttttaatttctttaatcagtttattgaatgcagaccaattctagtgtgcatatcgatgaaactgcagttgttcaacgtattttatggcccaatgcaaggtcaattcctggtcttgaagaatgtgataccataagattatagagaaaggttgtgggaaaacgcgtgcaaataaatgttgggcatatgtcattatttctaaatttagaatgggtcatttcatgaataaatcaatctagagataaatgtgagtgtttgggggtagagaggagaagatgaagatgccatatgggagtggacactgatcagaaatctttgcacatactgagaaagaaatcccaaggggaagatgtagatggtaaaggattatgactgtgccataggccactttctctagtaagaatgttagtttcatagggactgagccgatgcagcatcaaagttcattctagactcccaatcttctctctgaagaattttgccttcttatacaaggagcgctccagtggtagtttccagtgtacattcaatattgtcaagattttaaaatgagatcaaagtgaatttccatcttcataactcaaacttaagagaaggtatgacagcgagaagaattaagcataaaatatttctttccacaaattatcactggagaaaggttttgtgtggattgaatgcacaactggctaaataaagaaacaaatttatgaatgagaaaaacttgaaagcaaccaaagtcctcgaaagctttagcttgggacttaggaacaaagcactttattctttgagcaattatgcaaggaaatgaaatttgataatctattaaacgagagcctccatgcattagatctttctaactggctgtatgttaaatcaatataccgtggtatatacaaaacaggaagcaaaagccagaaatgatatacctgtgtcttatgttctggcacaatcagttctttccttggtggtttattcattttataagtatttgttaatattgaaagagataggcaaaaaacaaatgctatagtccctgatctctgcaagtgtaaaggtttggaggtaagaagtagtgacaagctgaagaaaggcttggggctgcagaacagtggtgttgaggacgacagtgagatacaattagttagtcatgttgaaagccgatgatgcaaagcaaggcgtcccagactctgaggctcaagatttaccctgcaggcaaagagaaccactgaaaatttctgtgacatgactcactattttagaggaaagttagggtttgggaagatcagtatagtgtaaaacagattcgaaagggcacctgagactgagatcagaaagaggctgttgtaacttactagacttgggttgatatgcattagaattaaggctgtattgtattcaatgtaaaagaaggtacatatgagaaggtattttgaaaggaggaagaactatccaatttggtgttggagattaatatctgaagaagcaaataaactcttggatttcgagtaaggaagactgggagaatgaagatattgctggtggcaatatgaaaatcagaaaaggaagaaatagcatatgtatgtatgaattcatttggaacataatgaatttgtcctaacagtgaaacatttaactggagatgtcatgtatagccagttagagatgaacaatttgtctcagcaattaaagaaaggaaagggaagtgagactaaaaggggtaagagtgagctttggaaggtgagccaagaaagaagagataaaggagtttaaatagaatgatttaaacagccaggaggaacccaatctcttctgaattaatagggcatgtctctgtttccttttataaaagtaatacaaatataacatctttttggaagcatacatcctgtttcaactattagatcatagatcacgaaagcttagaactggaagaaaccttgattgatacacgagggtctattcttcagaactatcccagatgggcagaaaactgccatctggtccatgagaactcataatctaggttgcagcaattcttcagtaaaagcatctcaggaaaaaaaggtccttttttatatgttccatgaggacagggacacatctttccctgctaaatcctcagtgagtagcacagtacctggcatataataggtgctaaattaatattagttgaatgaattaatgtactgtttattcacggatctttactattaacaactatattttgaatgaatcatttctttttcaagatccctgacacaagcttttgaaaaacttccctccctcccttcttcctttccttcttttcttccttcctccttttcttcctttcttccatttttgatgatgaaagtaaaaaaaagaaaagaagaaaaccatttagattcaattttgcctataatactagatttaaaaatgtaaaacggcaatttataaaacaaccctgaagtccaaatctcctccacatttgttttactctagtttttaaataatcatatttaagatttgagagttatgagggctatatattattctccttggtcttctcatttcagatgagttctgtagacagtatactgtttgcagagaccttcctttcttagcttcagtaagaaatatcactacattcattcaaaagatattgactagaatgtaagtttattgtccacaaagacagagatcttatctgtcttgttaagaatttatcacaatgcctagtacatagaagatgatcaagaaatactgaatggatgaatgaatgaaaggctttttgagttcctcttatttgtcaggcactgagataagtatgaatacggtagacttgaaagcgtaattctgggtataatgaatgagcaccaaatcatccaactaaattacgatacgacacacactcttaattccaagctgtgactgtttcccaaagctcagtccattcctctgtgtattgtgaaagataagctttatttcattttttcttcaacattgcttttaaataagccaaaagaataaaagaaagaaagaaaaaggaccgataacaacatcatggctcttagaaattatttcaaataaatttatctaaatgtaaatgttggttctttaactttgttttagattctcaagggcttccactttgtcttttgacctttctgttaattactctactttgagttttatcttcactagaagtttaggagagacaggcattacctccccatgtggaaatacactgctaggcaatgtggtttcttcctagtgtccaagctacatcttactgattactacatacataaatcatgtttactccagtctagagaaaatatgtaactaggaacgtatgttttgattttctggttctcagtttgtctagaccctagataaatatccatgggaatgcaagaaacagacatgacacttacacaaatgagcctattaaaacaaaaacaaaagcaaaagacagaaactcttgtgctgtgatgctagtaaataaaccacacatatgcacacaaatgactctccagtctattcacgagtttttgtcctgaagtttttcagtttgtacagtttctgtgtgcatgtgtctgtgttgggggaggaacttcctcgttcattcttactcccaaatcctcacaagtaacactcataaatacgtgcccaaacattatccgggaaacgctcctgagactgattacagtttcagttaaaatccttttaactaatggtaatccctttcagttaaaatccattattattctaattctgattcttttgagttgtaactgaaaaaataataaaaaaaaaaaaagtctgagataagttctggtcttgatttcaaactctcctgggcctcccagagtgctgggattacaggcatgagccacctctaccggccatcttctggaatgaagttttgtgataggtatagctctgcggcaaaacaacctgggcttgttgaatgcaaagattaactgaattgtctttcctttgagtttatttctgtgttttcctgacattagggcacttaggagttaaacagtgtttcttgcgtttgacttcaggatagatcacgggaaacaactagtgctaacatggcactcactctgagtaggagcataattcttaatagattttgtgtgacttatggcattgatactaatgccgtgccatctgagaccatccttaatctaccttttaaggttcctgcatcacagctttttttccttccattttatatttctgtgctgacttctttcttaatctgactcctttttttattccctcctttttctgtcctttctcctccagccctccccctttattatgttctatacaacctaccagaagagtacacagactctgctgaggcaaacagtgcctcaaatgaaggggctgtgcatgcttgcaagacaagcgaggcaggatatgaataggactcctagcctagtgccagcccaacgcttctccaagaacattcttcctctaattctgatgaactctgccatcaaactggaaggcaagagagaacaaaacagcaagctctttgtccgttgttaagcctttaatctttcacctcaccgatttctaaaatgcactttggatgtttgtttattggttttcttgcttatgcaactgcctcattctgtgataatggagtcaggttatatcaacattaaattgacttcatagacccaagtaccttaagggtatcattcattttaatttagaaaagcagcaatcaacctcctatcctgtttcatttgtcaaaatctttagttttaattacatctacagacttatgaaaattgtgacaggaagagaagagatcataggaagcatttcttctgcctttttttttttttttttttttggtctcagagagaaaagaggaaagttgaattactttgcctggaaggtgatgtaacttgatacagattttatcttaaaaaataggttcccttttaaaagttttcctaatgtatctcatgatttgcaacaggaactaaagtcaagtggctctcaccttacaacatcattacattaaatcatttacattccagccttagctatttattcttgagctttatttataccacatttggaagatatcgttctcacagaaattttctgaggccattggagcattcctttctaggggcattttggcccataagtagcataatgttcacatggtaattacataattatgcctcctggtatttgaacacaggagtatttccaaggaacaaaagtggcaatttgaaataatcatcagtgagataccatagaactggtattgtccgaaaaaaaaaaaaaagacggcatatattaggaaattcatattaacgaatgactgaaacaggtagataaatgcaaaaagataaagcactggaaatcaaacattttcatctcagtggcagaagcttttatattttgggtaacaatatacttgtagattttcagtttgttctactaaacacttctttaataaaggctggaagggggaatttgctgaagtctgcaacaacccttaaccgaggaaatcaaccctccttaaatcccgtaccatccttgcagcatttccaaagcttcctgaccttgactcccttcacagtcaatttgaccaccactcaaggaagcttgtccgccagaagaccctgtttccacttcccggctctcctcctctggcaagtgactgaaaagcgcctttcttttctctcactgatgcagaactgacaaaccagtatcaagccgttctttacaaatcaataaaccggaagatctcatctactgtacttccaaatcctacaacattctgtcttctctcttcttcgcatatcataagccacaagttatttacttcacgcttcttagtaaaggacaggggatggagcaatgtgcttccattgtttctctgtgtagatgtgtgagaaccagaattaaaactctgccatggactcacagtctctacggtctctctccctctgtcttctttgcacacttctgacctagccctcctcttctctccccctgcctccctcttccctcattccccctcaccccacccccaaggctgtttgtaagctccccaaatgctcataagactttcctgaactatttcagatattttcacttcaactctaaactaaaactattttgtttttccaaatgtggctttacatagtgcagaaaactacagggaaaacatccaaagtacaatgtgatcttttataggagaaacaaaagattgaatttctaggtcatcatggaagtaggtacacttccctgggcgataatctgaggtactttataagcttctttctttcacgaaagcaagaaatcctaaaatccatcaagatacgtgcactgtgcctcaactctctttttaatcctcaagtgaaatcaacacagtacagtgtaataaaaatgcatatagccccaggctttgtgccttagcaaagagagaaaaaataagcttcctgacttcatatgtctactgtgaataatcagtcactgcgtttttgggattttgctttataatcttaacgtatagcagtgaactccatgtttgtggtgtgacaagaataaaggattctttttctttctttaaaacaggttgttcccatattttccataagagagacatgtgtcggcttaaaagaaatgaaactacaatggtgtgagggaggaatctcctgattgttagcgtatattttctgcattttacctgaaattgtcaacgaagtgtaggtaaagttaaggcggggccctaggctgttcaataacgtggctaacatttggtttgagggccttctcagttctgttcccaaatagtcagcctttctttcccaactgcttgtccttagctgattagtaaataaccctaggaagataaatgattgttcataacaggcttccagtaccacagctgtgagtatttgcattttaagtgcaactttaaataattaagccattaattactcaaatacttattgagtgtttataaggcactttgctaggagaggaagcagaaaaaataaaaataaataagaaaacaaggggatggtctttagtgaatttgtagatttgatatttacaaataagcataataaagtattatgggaaagattttaatgtagtgcagtcattccccaatttgacagtgtatcacaactatttgagaacttttcaaaaaaatacagattcttagctcgtctaaataatttctgatttagttaatttgaggctgaggcttgagaatctttactttctttaagtctccacagatagttctgatgtacagcctggtatacatccatcagtgtagtggaaatgccacgaattttatgactcaggaagacctgagttggagtcccttactagctatttaaccagcatcttatctaacagcctgtgaaccttagtttctttatgtgttaatagaaataccacataacaacactaccaacaatgacagtaataatagcaaacatttatagagcatttactatatcccaagtgctatttcaagagcattataggtatatttcatttatgtctttcttatcagaaggtaaatttgatgagggcaggactcaatctattttattcattactgtacccccaggacccaggtcagtgcctgtctcatagtaggtacctaactaactacttgaaagaatgaacatcactatgaggaaagtacaccatagtgaccattttacagatgaggaaatggaggcacagagaatgagatgttgtaatgtgcacagttggagagaccactttctggcactcggtatgtactcatttttctgataactgcaaattgctagaacaagcctaaacagctatgggggttacagagtatctggatgaaattaatgaaggaggttgctttgaaactgggccttcacaattgggtaagcttttgatgggcaaaaacagaagaaacactctgggtgacaagagtagaatgagcaatttttttttttttggcactagtaaaggcccggatatgaaggataaacagaaaaagagttgaataatacaaggctagaaatgtagcttggagtcaaaccagagctgtacttgactgtcaggtttaagaatagagacttcatttagttgttcatgggaaggcattcaaatatttttttaataattattttaaaattgtatttctttcaaatgcattcacatgataataaaattcaagaaaaacaaaaaaagttatttaaaaatcaagtctctctttcaccatgtctctctagccattttcttccccattccctgatggcaagtatttccatactctacattaattttttaagtaagaaaaatattacgttggtgcaaatgtgatcgcagtttttgccattgaaggtaatggtaaaaccacaattacttatgtaccaacctaaatatcattgtcagaatggtgttttaggatgaatgaaagcatggagaaagcgaagagaggataagctgccagaaacgaaaacaagagatgttctgtgttaaatgtaacaatatcagaaagtagactcaaggaagcctcagactctcaccctaggtgaggaggagatggataaaaatcagaaggaaccactggtttgttgcagcatagtttgatgtaatagcaaatcagtaaatcatggacggttgaacaaagactggaggaatgatgggaaaattatgaaaggtgtggcagtgaattctccttaaagcccctcttatcattcattctcattgttagcaagatccctaccatagctggggcaaaaacaatgtatttaactaaaaatgagctaaggcgtgtaaagcgtttaacagcatctgttataaggtgagcactgagtaaatggtaactgttacttatttgtattaaaaggtggggctgggcatggtggtgcaagcctgtaatctctcacagtgacctgggaggctgaagtgggaggatcacttgaacccaggagttcaagaccagcctgggcaacatagtgagaccctgtctcttaaaaaaaaataacacaaacaaaaaacatggtgtcagagcagaatacaatggggtgagtttgacagacccatctttaggggaagttccatatctagcttcccttttttatagtaaatacttgagctggtttgttgagggtaacccatacgattttaatcatttaccaggacttaaatctggaaagtatgacagttgggttcaagaatcaatgattccaccagcattttcaagggctgctatgtacactgtactgtatgttcatcgtgtggtggatggcaaagatgggacatgaaaaatttcttttctcaagaaccttgtgtcttgctgggagatgactgcagctgagacgaattagagacttttgaactgatagtctctgtgttatgaccaataagggcaatatgtatttttggaagtgagacagcagtgaggccaggagcaatctgggaggcatcagaaaagaggtgacacagaacatcattgtcctaggtcagactcagtatcagcagcttagcatctcatgtccatgaggagtattttttgaacaggtattttgcatgccatttgtgatataatcttaatgattcagagattcctgagatttcaaacagtatcacttatagtgtcaatctttcctttattttagtaagcaacaagtcatcattctcttaccatcttttttttttttttttttttgagacgtcctgctctgttgcccagtctggagtgcagtggcatgatctcagctcattgcaacccctgcctcccaggttcaagcaattctcctgcctcagcctcccgagtacccgggattacaggcatgcgccaacccacccggctaatttttgtattttttagaagagatggggtttcaccctgttggccaggctggtctccatcctcctatcttttaaccatttcacggttgtttgcaaagaactttcaaaatacagtgattagaatgattcgttttcttgtcttttccttactgtattgaaattgattttttatggttaggtgaatatagatgattaaatataaaagcattgaatgattttgtgttgtttagataaaaactgtgaattttgcatgagtaaagggctagtatcgctattgttcctacttgaaaatgatttcagtgcactgatatcaaactttttctagacttttccaaagtaatcggaaatgctccaaattttgaaactttttgagtactgacatgacgtcacaagtggaaaatttcacacctgacctcatgtgacaggtcacagtcaaaacttttgtgtttcacgcacaaaagtatttaaaatattgtataaaatttccttcagggtatgtgtataaggtatatacgaaatataaatgaatttcatgtttaggcttgggtcccatcccaagatatctcatgaggaatatgcaaatattccaaaatccacaaaaataaaaaatccaaaacacttctggtcccaagcattttggataaggaatacttaacttgttttccgatctaacctggccctaacattcaactttgtaatatataatgaagaaataaaacaacagagtaaggccgggtgcggtggctcaggcctgtaatcccagcacttcgggaggccgaggctggtggatcacgaggtcaggagatcgagaccatcctggctaacacggtgaaaccccgtctctagtaaaaacacaaaaaaattaaattagccgggcatggtggcgggcacctgtagtcccagctgctcgggaggttgaggcaggagaatggcgtgaaccccggaggcggagcttgcagtgagccgagatcgtgccactgcactccagcctgggtgacagagtgagacaccgtctcaaaaaacaaaaacaaaaacaaacaaacaaacaacagagtaaacttccagagtaaacaaatctatacctcagggatatttaaatatcagaaataaactcatacttttgacttaccatcttcataaggcaatgcatatgctgaacacagatgattcttatctgttcaccaaactaaggtctttaaggactttaactactaagaatatttacgttaattcaagttaatatttgttttaaaaaacagaatcttttaaatattcaggatatagatgtttcaccaattcaatctaccctttctggtcaaaagttaaataaattggatggaatctcaagtattcataactacatataagaacaaaaactatcaagaatgtatcaacaaaaggtttccgtggcctctttcagtacacataagacatgtatctttttttttttttttttttttttttttgagacagagtcttgctctgtcaccaggctggagtgcagtggcgccatctcggctcactgcaacttccgcttcccgggttcaagcgattctcctgcctcggcctccccagtagctgggactacaggcatgcaccaccacgcctggctaatttttgtatttttagtagagatgagtttcaccatgttgcccaggatggtcttgatctcctgatctcgtgatccgcccacctcggcctcccaaagtactgggattacaggcgtgagccaccgtgcccggccaagacatgtatctttatagagcaaggtttctcaacttcagcattattgacattttggcctgggcaattttttgttgtgctatctatcccacgaattatagagaatgcctagcagcatccacaacttctacccactagatgccagtagcacctcctcaccagttgggacaactgaaaatgtctccagaaattgccatgtcccctgggggacagacttgctcttggttgagaaccactagtgtacagtaaactttcaccctctacttcatatacacagatattgatgtttgagataagagagtcctattctatgtctataactggttgaggaaggagaagttaacagtcccgagttatatacagactattgtcagatctgcccaattcagtattcctctaattggcagtctttgctctggcattccttgttgtgctgacacagagtctagaagatctgcattgtgatctgatggcttcccttgttcaattctgcttccacccctatttcttcacaggtgttattctgcaataaatctgccctggcatctgcttcttggaggactcaacctgcaacaataatcaatcaatcaattccacgattccattcccctagcctaggtgggcatgtgacccaatttgggccataaagagtcaagcccatacttgaccagtctttaagctctcgggtcagagtagctctctcttttctgcagggtatgttgagggtgttaagaggatggcaggtgggcctgcagcaatagtctgaaagccaccactgtcaccaacacccttttgtttcttaactaatctgagttgagttttctgtcacttacagccaagagtccagcctaatatactttataataaaggggaaactacagaaacatttaagaaaattagcattgatcctaaaagttgttacaaattacctcatcacaataactattcagagcaacgtatttaagttgctcaagaaccacaaagcacattgcctttttaaatttaaagagacttcataaaaatgtgggacagagcagaatggtacccattattatagaatgattttaccaactgcggcattaattctccaaagatttcccccagtctcattatgaagaaataatagacatagaatactaggctgggtgcggtggctcacgcatgtaatcccagcactttgggaggccgaggcgggcagatcacgagattaggagatcgaggccatcctggctaacggtgaaaccccgtctgtactaaaaatacaaaaaattagccaggcgtggtggcgggcgcctgtaatcccagctactcaggaggctgaggcaggagaatcacttgaacccgggaggtggaggttgcagtgagccgagatcacaccactgcactccagcctgggcgacagagcgagaccccatctcaaaaaaaaaaaaaaaaaaagaatactagatattagatgccacaaggttatcaatatacactagtttcgaggctttttgaaaattttggtgcacccctatccagcatatcccgcccctctctatttcacattccctgttgctaatattaggaaaagagaacgtttacgtgagtatgctatttgatttgaaccaacctctcagggtcaataatatttcagtattttgtgtgcagcatttaagattataaagtatgcccatttcagcactccttttaaacagaaagatttagttgaaaactcaaagccacatttgtccactgaaagcttttaaaaagcttcatttgtgaaaagacacattgaccagagctgctggggatcattaatgaaagctggatcttcaaaggagattctgtgttacaaaaaggtacttggacattttggctaagctgcagaccacctgtgatttggccatttgatagagggttggttgttgacaggtcctaagagataccccctatgtctcttctttttaaaattgtattaaaagatttgtatcatgggctccctatttaaaatgaaagtctgggcagctgccccttttactccgtctagaagaaggtaccttacattttctaacatgagttttccatcaataattgtctgctatgacaccaaagtattccccacctcctggctggagagcatgttgtcttggtcatctcctctgttatgttggagacagagtgacacacgtaggtgaatggggtctaaaccaattaaatccttgtctgggtctaaaccgattaaaaaggaactcaaatctattttctctcagattgggagagtccacgaaaataaaaaagccaaacaacagaaatgctgcccagttgcacaggatgttgctattatctagcatttgcacatcaatttatgttttcaaactcattgacagtcactagttaccggcaggcactctgttaagaagtagagaactctaagctgagttttgaccatagattcccggaagtgatttacaagatcattttcaaatttgtatgaccaaaaggcattttaaatatgattttaaattgcaaagggacgaaatcatgggcttcttgtgtttctttggatgccaatcacattacttcgagagctggcataggtcgtggatgtctcaggctacgcaccactgataacacaaactatgcgggcactggagcagaaagatatgagcagaggaagagagataagtggtgcctctaagaccccagaaagtggttttgaacccttgtggatctcactggaaagggattaggagaataccacctggcagaagaccattctcttattaaggctgatccactctctctctctctcaaaaaaaaaaaaaaaaaaaaaaaaaacataaaaaaaaaaataaataaataaaaaagataaaagaaaaaaaagaaaaaaaacttaagtaggagggaaagtctagagttgacagagctgaaaggctctcaaaattttaagacttttttttttaagtgtcttaaaatattttagggactttaactttgtcttagtaaagatgataaaattaagttcactacacactcattctttttagaagcttttcacctcccttttaactgtgtgcatttaatttgtgtaataatcactgtatgtccccttcaatgtccttttgtatctttttttttagcattttagtctatttctgtctgtctgatttttttcttctattcaaagacattttctcctctattatagctttatttaatgtttcccttatgctacagcataagtgcctttttttctccatccatatctctaaattagggggtccctcttccttttctatgcagcagtctgtcttcagcatgatgtcttcacttttctctattgtagtctcttttgtgattggccaatagcaaaatgaaacttactagaatccaatcccaaaagcactttagaaggatggaatcttatcatttactccctgaatcactatcatcagtacagttggtgtagaacggtattccattctggggctcattggataagtatgagttcaacctggcagctataaaataaccgggggaaaatcttgttcctttcctcctttatagctcggaaatttgtgagtgaccttgcttctttatttctaattatgccctatggaaaaataacgccttttttttcatttatattgtatagtgcctaagatttttgggggcctttaatgaacagcagtacaatttcattttcattttacaggatatgcaatataattttgaaaaattaaactacatgctcgaggaaggattcaacatttccggagaacctagcattttccctcagaagactaaaattagatcctgttttaatgactgtccctgcaacactgacttctatgtaatgagaatgtttccatgttcctgctgacagaccacctactattctttgctgatgtggggctgataattctgacaatcaataataataattgtataaacattaacatgtattgagtgcgtgctttgtgccaggcactgcacaaagtgctttataatgattatttcatttgatctttgtaataaccccatgagttaagaatacaaatgctctggcatatcagaattgttcacatttgatggttgactcaatatcgacttttaaaaactgtctagaaacctcccacgacacttactgcactgatggttctccatactcctccaatgacacaaagcctatcctgctttgaattcttgtattattattattcatatagggagaattcaacaaataaacaggtattctattgacaccaagaagactgacactgccgctgctctgctccactttgaggtttgtagcaaatatgtctggtgcttgcatcacatcttgtcagcccacctgtgattccagtgtcagcagtagtggacggttctgtgcaagttctaactcgtgctgtatagccagcatcccttctcaaaagggatccctgagcctttcagctttctgttctaggttcccctgacccccatgacatgggagcttcctgggtgggcaagcatagccagccacaggggttagtgctttggcagcaattctctttttcccctcccaacttctgcacagtgtttattgagcttactcatatcatatagttcacagctttgatagaaaaacttcttgtttcctttttgtatttatacttagattttctacattgttttgaatctttccgacgttgtgtgaagttcagagcagcggaaaaggcaggggtgcactggagaggatgtgtcccactcagatccaatgcttgcccatatcagatgaaaaaggaatcaattctcaaccagtgggagcaggagcaggtatacacatgctctggctttccatatttcaggctgtagctacctatatccagatttgttttcttctgtacacttctcaacagttccagagaattgctcatctttctttgtcgcttcattcttcttgttctcttattcctgcttcttagaattacttgcacccaggtccccccgcccttttttttttgagacagagtcttgctctgtcgcccaggctggagtgcagtggtgcaatctcggctcagtgcagcctctgcctcccgggttcaagagattctcctgtctcagcctcccaagtagctgggattacaggtgtgtgccaccaagcccagctaatttttgtatttttagtagagacagggtttcaccatgttggccaggctggtctggaactcctgacctcaggtgatctgcccacctcaacctcccaaagtactggtattacaggcatgagccaccatgcccggcccgaggtcccttcttgattctgtgatgaggtaacccctcactacaaagccaggtcttaggataggtctcaccatcattaaacctggactcttggagaaggcaaatgtgaataccattaaaaaccagaatctgtgatgttgacagtggaaagtctacatcactcattatttaagaccctctttgtcatcaataaatgttcatggaaattcaggcactatcttaggtcccactgctgaggccgggatttaatccagaatctgataacaagatttgttggaacttctgccttagggcaggagaaaacaataagaaagactttaaaataaggagagtcacctaatcagatctgcattttaggaggattactataggcgcattgtggaaaagggattcggaagcaagaacaatatcagggagataaattagaggctatgtagcatttgagtcaaaagatattggagtcaagggaggtgtaaataagggaatgaattaagagatggcttggggatagagctgacagaatttggcaatgcatcatgttagatttaaagataaaagtagattcagaaataataccctaatttttgacttgggcaattgggtgaagcgtagcgttcataagaacagcacaattagggagggaaaaatgttgagggtggattgggacaaaaggaggataataatgagctgctggggacatgttaagtctgaggtgtctgtgggacattcaggttgtggtggacaagaaacatagaaggtggctgggtctgaagcccaggagagaaataagtctgaccttacttcaataatcaagccagccatttcaaataattatgctagagcaattgaacatccatatgcaaaaaataaacctcaacttaaacctcatactttatataaaaatcaaatggatcacagacttaaacataaaatgtaaaactataagacatataaaacaggagagccaaaatggtgaaaccccgtctctactaaaaatacaaaaaattagctgggtgtggtggtggaggcctgtagtcccagctactcgggaggctgaggcaggagaatggcgtgaacccgggaggcggaacttgcagtgagccaagatcgggccactgcactccaagctgggcgacagagcgaggctccgtctcaaaaaaaaaaaaaaaaaagaacaggagaaaatctttgggatccagggctaggcaaagtattcttagactcaacacaaaagcatgatccataaaaggaaaaagcgataaattcaacctcgccaaaattaaaattctttttcatcccctgttaagaagatgaaaagatgagagagaaaacatttgaaaaccctatacacaagaaaggactagtatctgatacagaaagaactctcaaaaccgaactataaaaaaacttttgaattagaaaatagacaaaagacatgaacagacatttcaatgaggaggatatacatatggcaaacaagtacaggaaaagttgttcaacagcatttgccacgagggaaacgtaaattaaaagcacaatgagatattcctacacacatatcagaatggctaaaaataaaaaataatgacaacaccaaatgttggtgaagatgcagagaaactggatcactcatacattgctggtggaatataaaatagtacagacgcttcggaaaagtttggcagttttaaaactaaacattcaactaccatatgacctaacaattgcactcttcagcatttatctcagggaaataaaaacttatgttcacacaaaaacctgtacattaatgttggtagctttattcacaatagtccaaaactacagataactcagatgtcttcaaggggtgagtgattaaataaactagggtatatccaaaccatagcatacaactcacgataaaaaggaaacaagtcttgctgcatataaaaagagaaatctctagggaattatgttgagtgagtcaagtccatcccaaaatattacatactgtatggttccattcatataacattattgaaataacaaaattaaagaaatggaaaacagactagtagttgctggaagtaggaggtagggggggcagggaagtgggtgtggctataaaaggccaataggagggatctttgtagtgatgaaaatgttctgtatactgacaatattgacgtcaaaatcctggttgtgacattgaactagagttttgcaggtgtaccattagaggaaactcggtaaaaaggtatgtggagtccgtgtataatttcttacaactccatgtgaatctacaattaaaaatgctgagatctagtagttctcagtaatgtatcaatgactgaattttcatcagattagttatattgaatattaattctaaggttctgtcactatcccttttcaagaatctagaagcttagatttctttttgaagcaatataccaatagttttcttattaaaaattcagaaggcttcaatggcgaataattttttggtaataagaaaaaaaactaagaattattttttattaaaaaacaacaaaatcagctcttaagacacttacagttcagatggggaaataagatctagatatgtgaaaatgagtagtgtccggtgaaaggctcgtttctgggtggttagttcaaaggttccctggaggacgctgagcttgagctggatctgcaatcacatctggattgagggaatccttccagcactcagcaaatagcaggaaaaactgtccagacacagcaggtatcaagatttggagactttcctcatcaggagggaagcatttgttttgtttgtttggacatacaaggagacagaaagaatattgataatggatgtatttgaacccgatcttggtgacaatgttgagccaaagttgtaaacatgatgattaagaactcaggtactgaagttggactgcctggtgtgactacctcgtttctcaactgagagccactgggcaaagcacttaactcgctaagtttctgcttttgtatctaaaaatgatactactcatcagaggtacctcagaaagtagttgttagaattaagggagataacgtatgtcaagtccttagcacagtgactggcagagtctcatctggcatatattagctctgagcttaatgggggtgctggtggtgataatgacgttgtctctccaaaggttgcaaacggcttaggggcagagactatcgcttatcttagactacctgatgtctgggacactcctggcacacagcaggagttttgcgaaattaaactggcaaaagtagtgttcttgcaagattaacttgacagcaattggctgaccagatggaggaaggagagattttaggcatagagtacaagtagaaagctgctgcaatgatacaacttcactcctcatgacaagggtcagaaaaaatggttggtgtcagcgggaatgataaggaataggtaagtaatgaaagatgaattgaaggacatagttcctgggctttgactccacattttaactatgaatagattctaagcttgactgtagtgtgcaaattaggcctctttcggagagaaggcccagtatagcagaaagaacatgagttttgaagttaaacactgttctgtcccatatgtcatttgtgtgaccttaaaaaatgtatttacaaaaggcctttgacaaaattcaacaacccttcatgctaaaaactctcaataaattaggtattgatgggacatatctcaaaataataagagctatctatgacaaacccacagccaatatcatactgaatgggcaaaaactggaagcattccctctgaaaactggcacaagacagggatgccctctcttaccactcctattcaacatagtgttggaagttctggccagggcaatcaggcaggagaaggaaataaagggtattcaattaggaaaagaggaagtcaaattgtccctgtttgcagatgacatgattgtatatctagaaaaccccatcgtctcaaccccaaatctccttaagctgataagcaacttcagcaaagtctcaggatacaaaagcaatgtgcaaaaatcacaagcattcttatacaccaataacagacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaagaaatggaagaacattccatgctcatgggtaggaagaatcaatatcgtgaaaatggccatactgcccaaggaaatttatagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacgctacctgacttcaaactatactacaaggctacaggaagcaaaacagcatggtactggtaccaaaacagagacatagatcaatggaacagaacagagccctcagaaataatgccgcatatctacaaccatctgatctttgacaaacctgagaaaaacaagcaatggggaaaggattccctatttaataaatggtgctgggaaaactggctagccatatgtagaaagctgaaactggatcccttccttacaccttatacgaaaattaattcaagatggattaaagacttaaatgttagacctaaaaccacaaaaactctagaagaaaacctaggcattaccattcaggacataggcatgggcaaggacttcatgtctacaacaccaaaagcaatggcaacaaaagccaaaattgacaaatgggatctaattaaactaaagagcttctgcacagcaaaagaaactaccatcagagtgaacaggcaacctacaaaatgggagaaaaattttcgcaacctgctcatctgacaaagggctaatatccagaatctacaatgaactcaaacaaatgtacaagaaaaaaacaaacaaccccatcaaaaagtgggcgaaggacatgaacagacacttctcaaaagaagacatttatgcagccaaaagacacatgaaaaaatgctcaccatcactggccatcagagaaatgcaaatcaaaaccacaatgagataccatctcacaccagttagaatggcggtcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtacgtttattgtggcactattcacaacagcaaagacttggaaccaacccaaatgtccaacaatgataggctggattaagaaaatgtggcacatacgcaccatggaatactatgcagccataaaaaatgatgagttcatgtcctttgtagggacatggatgaaattggaaatcatcattctcagtaaactatcacatggacaaaagaccaaacaccgcatgttctcactcataggtgggaattgaacaatgagaacacatggacacaggaaggggaacatcacactctggggactgttgtggggtggggggaggggggagggatagcattaggagatatacctaatgctaaatgacgagttaatgggtgcagcacaccagcatggcacatgtatacacatgtaactaacctgcacattgtgcacatgtaccctaaaacttaaagtataataaaataaataaataaataaataaaatgtatttactctttcagcatctgtagtagacaccgtggcgctccaccctggacctcctctttagggcctttgcatgcatgggccacctgctgccttattggctgctggctcacagctggggccttcattggaatgtgccctcagggaactgcctcacacagctacatcccctccctcagggagagacctagggccaatgactggctgatgcagggattaactcatttatgcctagtgttccattattgggacgctaagcttgtgggagttttttatatcctactgctcaaggtcatcgccaaggtctgacttttcacaaaacatttttgcaacctccagcataaatgggttaaagtcttcacccatttgatttactggggacaactctgaaaggccaaacctactccagagcttccctgcatgctcctgctgcagccataattgcaactgcatggtgaaccagcttttcctctgcgcagtcatgcccctttcagtttcttagaggtgtaaatcctgagagcacttcccagtatgacaataatccttctgcaagcaactctccaactgcttctgcttctgagcctagtcttggagagccttttattcctaatctgtgaaagggaaaaaaggtacacagttgttattgagagttgtgctgggaataaaacgagatcatgtgcttggcagaaaaccgtgttcaagcaatgacagctaataggtgatacttgaggacattatgctacgtgaaataagccagtccaaaaaggaacaaatactgtataattccgcttacatgatgttcctagaatagtcaaatgcatagagacggaaagtagaaagatggctgccaggggctgggggaaaggaggaaatgagaagtggtttaatgggtacagtttcagatttgcaaggtgaaaaagttctgcaagtccactacatgacaacatgaatatacttaacattactgaactatactctaaaaaatggttaaaatggtaaattttacattatgtgtttttaccacaatttgaaaagaaagaaatgatggctaccataccattgattccatttaattgattttacccacaagcaggtaccttttctggcttctcctgtattttctcatcctgttgggtgggacctatagtttcaaacatgattgaagctccctgcctcctctgacaccctggatattacgtctccgtaatctgattttttacaccaatgtttctaatctccacacatctctttagactttagattctctcatgagctgaaatcaccctggcataggctctgaggaactgcatggaagcaaacagcactattttccttccttcctctaacaaaacagatctctttaaaatcaccaccataacctttcgaaaagcacatcaaactgcatcatgatacaaaagaaattatactctgtcggtgccaggttgttgaaaataagggattgagatcaggagtctggggaagttgacagatataatgatgtgcttagatatcctgatggattttgacacagattctctgcttgggggtgagtgtaattactatttgtacagagagcagagtcaaggtcagaaaatacaggagagggacccatcaagctaaagtagaggactttaaagtggttggggagtttttgttattcagaagctcaaactggtcagcaggacaaaagaatatacagagtcagggtatgggcaggggccaatatccaatatccagaaattcctgtctagcaagaatggagaggaaatgtcagagcatgggttggaatttggaatgaagttatatgaggaaacagacaaggtacaaaacgtgaccaagaagttggaggtgccactgcaaaatttggaataaaaggggtagtgccaaggcaggtctgaggactgatcctaagccagtggttgtttcttctgtcctagttttaagcagctttcctagtgagggtggatgagggccaagagcactgggcttctccccagagtcacacaggattctgcaggttttaatgattacagcagagagagcttggtcccctggaaagcccttgcggttctaacccagcaaaatgcattgaatctgacaggccagcatttaccacctctgatgccagtgcatggggaaaaacaaattgccccatttgcaaacttagtacatatatgcagttaggagttgctctactcgttacacaaaaagattttataagtaaaaaatacttaaagtctggcactaagtttctactccctgtttgttttgattttgatacctgtactctattctaaagacttggtagtgagagtagagcgggaggtggcggggggaattgaatgcctcccaagtatttgaagggctgtctttgccaagagggtttacacttactgtgtatatttccaaagcatacatatagacagaaaggcagaggttatgggaagatcaacttcagctcaatgcaagagataacagcctaattattagggtgtttgtgaactgaacaggctgctttacaaagtgaggagttccccatcactaagttttaagcctaggccaaagtgttttctagcagaaatgtggaagaactcctgaaaggatttagactagatcttgaaggcccctttcaacctaagattttattactcaaacttgttaagatgtgattaacactagcttaaataagttaactatcgagagtcagcctaatgtaatggttaggattaccaggtctgcagccatattacctgggtttgaatcttggcttcttactagctgtgggctttgggcaaattactcaatctctctataccttagtcttcttatttgtaaactgggaattacaacagtacctatctacaagatcgttgttgtcaggcctctgagcccaagctaagccatcatatcccctgtgacctgcacgtatacatccagaaggcctgaagtaactgaaaaatcacaaaagaagtgaaaatggcctgttcctgccttaactgatgacattccaccacaaaagaagtgaaaatggccggtccttgccttaactgatgacattaccttgtgaaattcctttccctggctcatcctggctcaaaaagcttccccactgagcaccttgtgactcccactcctgcccgccagaaaaccaccccccatttgactgtaattttcctttacctacccaaatcttataaaacggccccacccctgtctccctttgctgactctttttggactcagcccgcctgcatccaggtgattaaaaagttttattgctcacacaaagcctgtttggtggtctcttcacacggacgcgcatgaaatttggtgccatcactcggatcaggggacctcccttgggagatctatcccctgtcctcctgctccttgctctgtgagaaagatccacctacgacctctggtcctcagactaaccagcccaaggaacatcacaccaattttaaatcaggtaagcggcctctttttactctctcctccaacctctcactatccctcaacctctttctcctttcaatcttggcgccccacttcaatctctcccttctcttaacttcagttcctttccttttctggtagagacaggagatgcgttttatccgtggacccaaaactccggcaccggtcacggactcggaagagtcttcccttggtatttaatcacgcggggatgcctgcctgattattcacccacatttcagaggtgtctgaccacacggggacgcctgccttggtccttcacctttagcggcaagtaccgcttttctcgggggcaagaaccccccaacccttctctccatgtctctaccccttctccgcttttctgggggacaagaaccccccaccccttctctccgtgtctctactcccttttctctgggcttgcctccttcactatgggcaaccttccaccctccattcctcctttttctcccttagcctgtgctctcaagaacttaaaacctcttcaactcacacctgacctaaaacctaaatgccttattttcttctgcgatgccacttgaccccagtacaaacttgacagtagttccaaatagccagaaaacggcactttcaatttttccatcctacaagctctaaataattcttgtcataaaataggcaaacggtctgaggtgcctgatgtccaggcattcttttacacatctgcccctccccagtctctgttcccaatgcaactccttccaaatcttccttctttccctcccacctgtcccctcagtcccaaccccaagcatcgctcagtctttctaatcttccttttctacagacccatctgacctctcccctcctcgccaggcccaattattcctcagcctctgctcctccaccctataatccttttatcacctccgctcctcacacccggtccggcttacagtttccttccatgactagccctcccccacctgcccagcaatttcctcttaaaaaggtggctggagctaaaggcatagtcaaggttaatgctcctttttctttatcccaaatcagatagcgtttaggctctttttcatcaaataaaaaaacaagcccagttcatggctcgtttggcaacaaccctgagatgctttacagccctagaccctaaaaggtcaaaaggccgtcttattctcaatatatattttattacccaatctgctcccgacattaaactccaaaaattaaattccagccctcaaaccccacaagacttaattaacctcgccttcaaggtgtacaataataaagtagaggcagccaagtagcaatgtatttctgagttgcaattccttccctccactgtgagacaaaccccagccatatctccagcacagaagaactccaaatgcctgaactgcagctgcgaggggttcctccagaatggcctcccccaggagcttgctacaagtgccagaaatctggccactgggccaaggaatgcccgcagcccgggattcctcctaagccatgtcccatctgtggaggaccccactgaaaatcggactgttcaactcacctggcagccactcccagagcccctggaactctggcccaaggctctctgactccttcccagatcttctcggtttagtggctgaagactgacgctgcccgattgcctcagaagccccctagaccatcacagatgccgatcttcaggtaactctcacagtggagggtaagtccgtccccttcttaatcaatacggaggctacccactccacattaccttcttttcaagggcctgtttcccttacctccataactgttgtaggtattgacggccaggcttctaaacctcttaaaactcccaaactctggtgccaacttagacgatactcttttaagcactcctttttagttatccccacctgcccagttccctattaggccgagacactttaactaaatgatctgcttccctgactattcctaggctagagccacacctcattgccgccttttcccccagttcaaagcctccttcacatctccccttgtatctccccaccttaacccacaagcataagacacctctactccctccttagcgaccaatcatgcaccccttaccatcccattaaaacctaatcacccttactccgctcaatgccaacatcccatcccacagcacgctttaaaaggattacagtctgttatcactcgcctgctacagcatggccttttaaagcctataaactccccttacaattcccccattttacctgtcctaaaagcagacaaggtttacaggttagttcaggatctgcaccttatcaaccaaattgttttgcctatcaaccctgtggtgccaaacccatatactctcctgtcctcaatacctccctccacaacccattattctgttctggatctcaaacatgctttcttcactattcctttgcacccttcaccccagcctctcttcactttcacttggactgaccctgacacccatcaggctcagcaaattacctgggctgtactgcctcaaggcttcacagacagcccccattacttcagtcaagcccaaatttcttcctcacctgttacctatctcggcataattctcataaaaacacacgtgctctccctgctgatcatgtctgactaatctcccaaaccccaatcccttctagaaaacaacaagttttttcctcctaggcatggttagatactttcgactttagatacctggttttgccatcctaacaaaaccattatataaactcacaaaaggaaacctagctgaccccatagatcctaaatcctttccccactcctctttccattccttgaagacagctttagagactgctcccacccgagctctccctgactcatcccaacccttttcattacacaccgctgaagtgcagggctgtgcagtcaggattcttacataaggactgggatcacgtcctgtagcctttttatccaaacaacttgaccttactgttttgcctagccctcatgtctgcgtgcggcagccgccaccaccctaatacttttagaggccctcaaaatcacaaactatgctcaactcactctctacagttctcataacttccaaaatctattttcttcctcacacctgacgcatatgctttctgctccccggctccttcagctgtactcactctttgttgagtctcccacaattaccattgttcctggcccagacttcaatccggcctcccacattattcctgataccacgcctgacccccatgactgtatctctgatccaccagacattcaaccccatttccccatatttccttctttcctgttcctcaccctgatcacacttggtttattgatggcagttccaccaggcctaatggccacacaccagcaaaggcaggctatgctatagtacaagccactagcctgcctcttagaacttctcatttcctttccatcgtggaaatctatcctcaaagaaataacttctcagtgttccatctgctattctactactcctcagggattattcaggccccctcccttccccacacatcaagttcgaggatttgcccccgcccaggactggcaaattggctttactaaacatgccccgagtcaagaaactaaaatacctcttggtctaggtagacactttcactggataggtagaggcctttcccacagggaaacataattcctcggtttggccttcccacctctatacggtcctataacagactggactttattagtcaaatcacccaagcagtttctcaggctcttagtattcagtgaactaatggtcttttaaaaacacacctcaccaagctcagccaccaacttaaaaaggactggacaatacttttaccacttgcccttctcagaattcaggcctgtcctcagaatgctacaaggtacagcccatttaagctcctgtatggacgctcctttttattaggccccagtctcattccagacaccagaccaacttagactgcaccccaaaaaacttgtcatccctcctatcttctgtctagtcatactcctattcaccagtctcaactagtcataaatgccctgctcttgtttacactgctggtttacactgtttctccaagccatcacagctgatatctcttggtgctatccccaaaccaccactcttaactcttaaagtaaataatctttgctggcaaggctatgctgaacctccttaggcactctctaattagacgtcctaggtcctcccaattcttcgtcctttaatacctgtttttctccttctcttattccgtttagtttttcaattcatacaaaaccgtatccaggccatcaccaataattctacatgacaaatgtttcttctaacaaccccacaatatcaccccttaccacaaaatcttccttcagcttaatccctcccactctaggttcccacgccacccctgatccacctcgaagcagccctgagaaacatcacccattatctctccacaccaccccgaaaattttcgccgccccaacacttcaacactattttgttttatttttcttattaatataagaagacaggaatgtcaggcctctgagcccaagctaagccatcatatcccctgtgacctacacatatacatccagatggcctgaagtaactgaaaaatcacaaaagaagtgaaatttaaatggcctgttcctgccttaactgatgacattccaccacaaaagaagtgaaaatggccggtccttgccttaactgatgacattaccttgtgaaattccttctcctggctcttcctggctcaaaagctcccccactgagcaccttgtgatccccactcctgcccaccagaggacaacccccctttgactgtaattttccttaacctacccaaatcttatagaacggccctacccctatctcccttcgctgactcttttcggactcagctcgcctgcgcccaggtgattacaaagctttattgctcacacaaagactgtttggtggtctcttcacacggacgcgagtgaaagttgtaacaattaggttggtgaatagatatgaagtacgtagataatgcttggtatgtagtagttagtattacttctgttgctgctgctactactactactattactactgatagggacaggaggcagggaaattctggacagaagagggcgggtctctggcaagggccccacccttaagcctaaaagcctggaactgtggcccaaagtgagaacttacatccctgttttcctgctcaaatgttgccttttccaaaaccacccatagcccaccctgccctccatcctgtgcctgtaaaaatcccaggctcagccggcacagaggagaagcagctggatgttggaaactatggttgtgcattggagagaagtggcttgacttccgagggacagcctggcagcatagcttcagagaggagtctgattgcggacagctggactcgaggtgaagattaccttcctgctctgtccccttttcagctccttttcctgctgagagccactttcatcagcaataaaatcccccgcatttaccatctccaattagtttgtgtgacctcattcctcctggaaaatgggcaagatctgaggtgccacaagtgcgagtacagaaggctgtcacactgaccctccactgagctgttaacacttaagccatctgcagatggcaaagataaaagggccctgtaacactccttctggggattcaagggtcgcgggcaccctcctagacactgccatggggcccacacagagttttgttcctgctggcgcccaaaagcactcaccctggctcctgtacccactcacctgtgcttcctctcccatgaggggtggaactcagtgagactgagccagtggagtctgcccctgccagcaccgaagcggctatgcagtccagttcccgcccgcgaggggatcagggtaatatcctgcttcactactactactactactactactactactactactactactactactactactttagcttcatagatatcaattcttgctttttggttgtgattttgtactctgatgaccagagaagagaacagggacctgtggaatataaattcatggtgaagtacatgttatgttatcaattcttgaaaaaccctgaaatgtagactcatttcccccatgcaggtttgttgtttttgaggaaagaaatgacagctgtgaaacaagtctaaattgtgccctaatgtctgagtgtccaacagtatgctgctgttgaagcaatagcaaagcagagacaaaacctattgtttcctctccctgtataactgaaaccatggccggttgcccttttctgtccatgatgtggaaagctctgctctcatgacctcaaaaatgggcatgtttcaccattcactcagagaagatcctattacagaaaaacaatacccagctgcaatttaactcagagctgagaaaccctctacccaatgattatgggcccacttttgtgatctacctgtgaggcaaaaagaacattctttcaacgatgtgcgtaggatgtctgtattaggaaaactgataaatggaaacgtggaggacttcaaataattctcatcaagtctgttcttaaaatggcaaacttccaaagtcccttgagaatacacaggtctcaatgagaagaaaaagcggctgataaaacattaggctttccaaaaattgcccatttctcctcaaaattcctacatgaaggttcacaaggtttaacgtacaggttgttggaagcacaaacaaatctacctcaggagagttaattcacctcaggaccaatttctcctctgctggtacatctactattcatttagcagccctgcttggataaagcccagagccatttcaacggcagtaggaagggacgtttagagagttatcatcagtcatttatgcctgcgctgttaacaactgaatcaataacatcagtgctatggagagcaccttcagagcctagttaggatgtctgcagttgtcagattagacaggcaagatgttttggaaacatatttgtttcaggaaatgtttaagtggtaagcatccacagggttctgtggccatcctgttcacaaacatggatatattaatagatttaatttggttgactaatgaagatatttattgttgctttaaaaaaaattcttataatttttgtaggtacacattaagcgtatatatttatagagcatatgagatgttttgatacaggcatgcaatgtgaaatcagcacattatgctttttatattaagagatgatgttcagagaaatgcaaatcaaaaccacaatgaggtaccatctcacaccagttagaatggctatcattcaaaagtcaggaaacaacagatgccagagaggatgtggagaaatagcacttttacactgttggtgggactgtaaactagttcaaccattgtggaagacagtgtggcaattcctcaaggatctagaactagaaataccatttgacccagccatcccattactgggtatatacccaaaggattataaatcatgctgctatgaagacacatgcacacgtatgtttattgcggcactgttcacaatagcaaagatttggaaccaacccaaatgtccatcaatgatagactggattaagaaaatgtggcacatatacaccatggaatactatgcagccataaaaaaggatgaattcatatcctttgtagggacatggatgaagctggaaaccatcattctcagcaaactatcacaaggacagaaaaccaaacattgcatgttctcactcataagtgggaattgaacaatgagaacacatggacacaggaaggagaacatcacacaccagggactgttttggggtgaggggagggaggagggatagcattaggagatatacctaatgtaaatgacgagttaatgggtgcagcacaccaacatggcacatgtatacatatgtaacaaacctgcacgttgtgcacatgtaccctagaacttaaactatagtaataataaaaaaaaaagaagagatgatgttgatgggggttggttttcctatgtctgtgtgaggctgaaaagctggtattttcagttttctgtttttcagaaaatgccttcccctttgggttctgtattatgtaatcatagcacttttaatgccttacctcatttaatttcttcatatgggagggaggtctaactctgctagtctttatgctccctggggacaggggtctaatccatctctgtgtttccagaatttaacacagtgcttggcacataatggatgctcaatattgtttactgaatcactgactgtatgatgaatgaatgaacacatgaagtaaaaacatgatttagagtcctgatctatctaatcacaaaggaactctttggtttcaatctatcaagtagttgtgactgtcataatggctttcagctgtctttagctctgcagtagtttttttaataggcttcattctagacacatatactcaggtgttcctgagctgcttccttaaggcatttcctcggtcagatctacttatggttgacatctcaccacaactaacatgaccaccttgggaatattgctcttttttgcgtaatgtttgggccaacaggttatgaagccaaacacagtgattaggactagtggacttgggggcttcctgggggagcattacaggtgacacaaaatccttggttgacattaagtacatttgtggatttgatgcttacaaatccagctgtgactcccttggcaagttcaagtcttagactctataggaagctaaaaatggtcattgttccatcaaatttggtatgatctgaaatctacagccatgctttctgtcattttttaaaaggcacattgacctcaaagagcacaatttgagaggaattcagatgaggtgaattctaacccagatatcacattaaatagctgtgtcatcttggccaagtcttaacctttttgaacttgtctagtaagggtgttagactagatgatctcatgatatgtaaattaattctttttttttttgtttgagacagagtctcgctctgtcacccaggctggagtacagtggtgcaatcttggctcactgcatcctctgcctcctgggttcatgtgactctcctgcctcagcctcccaagtagccgggactatgggcatgcaccactatgcctggctaagttttgtatttttagtagagacgcggttttgccatgttggccaggctggtcttgaactcctgacctcaggtgatccacccgccttggcctccaaaagtgctgggattacaggtgtgagccaccacacctggcctaattcttttaaatgttatataatcagcttagtcttgcctcaaggactttttatgtgttgccctgtttgggacacaattcctcatgaactttcgggtctccctccccacttctttcaggtctttcctcaaatgtcacctcctcagtggaaccttccctgatcaccttatataaaatgacaattccttccatgaacaactctctagcgtcttccttgctttatttatttcaacatgctgtcactatttaaaattgttatatgataattgtgtacttgtttatcatctttcttctttgtttttcggttttttttttttttgagatggaatcttgctcagtcacccaggctggagtgcagtggcacgatctcggctcactgcaatctccagctcccaggttcatgccattctcctgcctcagcctcccgagtagctgggactacaggtgcccaccaccaagcccggctaattttttttttgtatttttagtagagacggagtttcaccatgttagccaggacggtctcgatctcctgacctcgtgatccacccgccttggcctcccaaagtgctgagattacaggagtgagccaccacgcccggcctatcatctgtcttctttacaagaatgtaagctctcctgagggcaggggttttgtcttgtttgctgctttattatcaatacctaaaatggcgcctggcatataacagacccacaatagatattaattgaatgactaagtgaatatttaaactcctagctaaaaagtcttcagggtttcttaggtgtaatctggtttaacacaccaagttgagaatcacagaattattagataattaaagcgaaaaaagacattaagtttacctagctcaatacctcattttgaagacagaaaaagtgaaagtcaaaatggttaaatgaggccaggagcggtggctcatgcctgtaatcccagcactttaggaggccaaggtgggcggatcacctgaggtcaggagtttgagaccagcctgaccaacatggcaaaatcccgtctctactaaaaatacaaaaattagccaggcatggtggcaggcacttgtaatcccagctgcttgggaggctgaggcaggagaattgcttgaacccgtgaggtggaggttgcagtgagccaagatcacgccactgcactccagcctgggtgacagagtgagactccgtctcaaaaaacaaaacaaaacaaaaccaaaaaacatttgagaccattggaagagctgaatctcagcatcctattaggaaaagttaaacttacagaaaatttgcaaaagtagtatagaaagttcccatatacaatttgtccaacttccaacttcttttactaggaaattagtttgcctgcccaagaaatgtctgcaaggggttttatgactatttcattttgatcctctacatattgaaacttgagatgctccagctgacttattcattatcttgggggagtgtagattatttgtgcaacaggcatattcttattttaagccattttatccaacgtcatcaaatgatttaacaagagacttttaaacttctcagaatattcttccttataaataacaggaggtgccttagtttaggaatggcagacaaatgtaaagcacttgtaccattattttctcatttaataccaatggtagaaattactaatcagcctatggcactgtattgtagtcttccccaatttgctttatgctcttttacaataaaccactctaggcagctgatatcagtcaataagagcttgcttgtgagatgaacaatatttaccattccagatatagtgcagtaaggaataagataaagatgccgaaactcagattctattataatcacagattatccattgattagcttagtgagttttaaaaaatcatttctacacttctgtgccctacttcacacagttaggatgagggttaaatggaatagacacatctaaaggtgctttgtgaaatgtaaagaattatatacatgaaacctgatcttaggatattcaagaaaattgaccatagaaatgcatttctccaatatactttaagaatcctttgtttttctaccatctgtttagtttagtctgtatacatctaacttttattcccatgtccaacagaactgaagttagagtgtgagagattccttcttcagctaatggaataaatgatatagagctcagtggataaacatgtgcttgagtgccattctagagcaagccctcatgacagctgagccagagaaacatatttcagccacttccctatctcattgcttcatatctcagataatttagaagtatatgattttaaaaatcactgctttctgatcaagtatcaattaacatcctcagataatttgggagggtgtgggattcgtagccggattgtagcaaagttggaacttaaaatggaaaaaaaaaacaaaaagcccagaccgaaagccatccatcacttacacatttattcacatccttgaattctgagatgtcatattcttttgatttttgactgacttctcttctcctacctctgcttgacttctttttcttgaagtttatcaaggtttggtcctaggccatcttcccttccctctttacatgctaagtgatttccattctggatgctctaaattccattttgtatcaatatttttctcatttacgcttctagctcgggtctctcctttgagctataattgaatttgacttctgcacttggacatatcacacacatttcaaactgaacatgtctaaaactgaactgttgatcttttccaaatctgcttcctcctccatctttatcacctcagcaaacagtacaacaagttgatcaaacaaaaaaaacttgggagtcatcctcaatccctcatgcctgacatctaatccatcaccaagtcatacagattttgtctcgaaaatacatctcaaatctgttcatttctctctatttccattgccgccatcttactcccagtagtcattttctttcatcaagacaactgcaaatgcctcttacctggcctctttgcttctactcttgccacattcaatctctcatttatacagcaggtccatcagattgtatgatgttttgcaggtacatcagctcaggtgtactttcacaggtacgtcagattatattatttctctgcttacccataaaataaactctccagccttgtcctgtaccactcaccccctcagtcattagctcctagccatacttgcctccttttaggtcattgtcttgaaaatattattccattcccctccctgttcatatgactgacctaaccttcagattttagcttaaatatatccttttcagagaggccttcctagactatgaagaagttcccactattattcttccaaagtagcctattctttgtcttcataacatttctcactatttttctttttattttatttttatttttttgagacagagtcttgccctatcacccaggctggagcacagtgacgtgatctcggctcactgcaacctccgcctcttgggttccagcaattctccggcctcagcctcttaagtagctggaagtacagacagggtttcaccatgttggtcaggctggtcttgaactcctgacctcaagtgatccgcccgcctcggggtcccaaagtgctgggattacaggcatgagccactgcgcctggagcatttctcactatttttaataatatattaatgctaacatttttactggctatttgtctcactgtcttgcaaattccttggcacgtccaaaaatatttcttcctattttgtgccagacaatatgccgggtgtttggactatgaagatttataatgaaaggtccttgaactaaaaggctacacattggctgggtgcggtgactcacacctgtaatcccagcactttgggaggctgagatgggcggatcacgaggtctggagttcgagaccagcatgatcaacatggtgaaaccccatgtctcctaaaaatacaaaaattagctgggcgtggtggcacacacctgtaatcccagctactcaggaggctgaggcaggagaattgcttgaacctgggaggcggaggttgcagtgagccgagatcacgccactgcactccagcctgggggagagagtgaggctccatctcaaaaacaaaaaacaaaaagcaagcaaaaaaaacggccacacatttagtaggaaaaatcaagaaaaggtttataaatagagtggtagacactgttggttgcctcatcaacaaccattccactctcccttttttctctagtgattatctatttccacacacacaaaaaaaagtttaaaaagcactgatagtcaatttcttagtttcccttgcaggtagatgcagctacttgacctagttctggccaaagagatgttagggagacatgctgttgcttctgaaacatgacaagaactgccactcttcctttattttccattcacactgtcatgatgcaattcctggagtgtggcagccattttataaccatcgcgtgacaattccaaagaccaaagccaaaggctaaggatagcaaatgcaaagatggaaagacattggattctgaatgaaactgttgagctaataaaccaattttgggtatatctttctcttaaattcctattatgtgagaaaaataaacgatggttgcttacattttcattatatatccctttactagaagttaaagcctctataccgacacaaactgttcctgctgtgacaacaatatagccagcacaagtccccccaaaccacagatcccctgaccctggtgtcaagattgggtcttctaattctgcatctgggtactctaggaagctttgtggcttcccatttatatgactgaagcgcgaactgtgtctatatgtgtatgcacacatgcacactggagagaaaggacaaaagatcattccacaattgagacttgaaggctaaactgtaagatggctgtacgtaataaagctctaatcctctattaggctcctgaaatctaggttttatggtttagtaatgttttcattatttcaaagactcagaattctttctctctgaggcatcacaaaagcttccatagaaacagatagagaatgaatgtcacaccaagaataggaaataaagcaaagaaaaatttgcagtgaactagtcattaatgaaaggtataaagagtgcatgcaaaatgttaataaatcattaaaaggttaggaaagtttccagcaaggaagaggtctctgagccaaaaggttgaggataacaaggtacctcattcagccatattctgtcatcatctccacatatcattgttttgaaattttaatatggaaagcaggtcattcttttaaaaaactgaactgcatctaaaatcaattagatctcatgatctacatgttcacctcatcttagggcacagtatagtaaatgatcttaacttgtttaaaatattttttcttggctgggcatggtggctcatgcctgtcatcccagcactttgggaggccgaggcaggtggatcacaagatcaggagttcgagaccagcctggccaaatatggtgaaacccggtctccactaaaaatacaaaaattagccgggcatggtggcggacgcctgtagtcccagctactctggaggctgaggcaggggaattgcttaaacccaggagacagaggttgcagtgagccgagattgcgccactgcactctggcctgggcgacagagtgagactccatctcaaaaaaaaaaaaaaacaaaaaaaaaaaacaaacccaactttttcttaaaatcaaatattccataggatggtgtgatgagcattcacatatcaagagaatacatcatcatcgtcatcatcatatcaacaactagaaattattgaataccaactatacaccaggtgctccactttgcattttgcaagcattgtctcatctaatcctcagacaactctttgagcgagtgctattattactcctattgaacagataaataaatggaagcactacaaaagggagttgttagtaagtggtgaagttccaattcacaccccacacgttgactcccagactctgaaaattttcagactctaagcttaaaaatatagaaataagcaaatgaataaactagcgttcttatcagcccagaaaggagtcttcactttatgcatgttaaacactgttactgttagctaaattgctctttacaacaaggcttacaagatgatgatactatcaacattttgtatatgaggaaactgaagtcttaagataaatctagctagctatggcagagccagaacctgagctctgtttatttttattctaaagctatgtcaatatttgctaatacttggtattggtaatattacaatggctttctttttatgacacatgatatccatctcaaaaatattagattataacatttgtatgcaacttaagaaagatgaagttatttggaaaagggattgagatatgaagattgtgatataagaattgttaggtgactacagctctgatggaaaggtttatgcgcaccagaatctcagctgtagctctgttctctttggagaaacaacttgtaaaaatatgatccttgttagcaggatatctaatatccattcttgttccattgatagcatttgaaatttatttatcaaataatcacttcagtttttctaaactaccttaaaaatatttttaaaacctgaggataaagaggacacatttttaaactagtgcatttttctcttacaattaaatcgatattccagctgggtgcagtggctcgtgcctgtaatcccagcactttgggaggtcgaggtgggtggatcacctgaggtcaggagtttcggaacagcctggccaacatggtgaaactctgtctctactgaaaatacaaaaattagctgggtgtggtggcacgtgcctgtagtcccagctactcaggaggctgaggcaggagaattgcttgaacccgggagccagaggttgcagtgagctgagatcatgccattggactccagtctgggccacggagcgagactctgtctcaaaaaaaattttttaaagttgatattccatttatttttctccacttaaatacagattttttttatgatctcataaggatcacaatgaatagctaggccttagttttgcagctttagtttcattactatgagagagagagaagggtgagagagagagagagagagagagaccaagtgtggtgagaagacatatgttgtctttgtgggtccagtatttcatccttctactaactgcctggttgttgtttctgtttttgtttttcctttgaggaatcgctttccccatatttcttgtgactctagtagagctgccaatcatggtacctttttgccttcctcaattcccctaaagagttcaaagaccccataggttactcagactctgccactcaggaagctgacaaaggaagaaaataatacaaggttggaaagactttggagcttagtatttcaaagacaacacttaaaaagaagatgcatgtgttcctgcttttgagattttagaactcttatacttcatgtcctattctgagacctagttttcaaattacttcgttcatttctatgagtatcttttaaataaagagcccctaccccatcccctttgttttccctgacttgaattagccagagttagctgctggtgtttataactgaagaccggcagacactgccggttagctacttcaatacctgttgaaaaccacttctccctagccatctttttgttggtggctgtcatgtgacacagttctacacaatgatatacaagtagaagtctttcaaaaaaggtttctgggaaatttttggctttataaaaatgataagactcagatagtacaccctttttgccttctctttttcaccctgtgaaataatggtggctgctatattgcatgaggaaaagtcaataaaaaatatacagatgccagtcctgatactgttgggcccaaagcaccttatttccagacatcttaatattggagataaataaaactctatttatttaagccactgtagatagcttctgtgttttttgctgccattgcaattctaaccccagccaataaaatgggaatatgaaaaacaaacaaaaaatatgaatccttctaaacaatgaagaatttatggggttagggtttgggaggaacagaagatatagccagatgaatttaggcatatctctcaggaactgacctttgtcctttagctattactgttgattagtcttagatggcagtgaaccttgtagctgatgttaatgcaaaactggagaacattgcatcctggatataggtatattctgatactctgatacagggcccttagcttccaaagatgacaattttttttttttttttttgagacggagtctcgctctgtggcccaggctggagtgcagtggcgcgatctcggctcactgcaagctccgcctcccgggttcacgccattctcctgcctcagcctcctgagtagctgggactacaggcgcccgcaaccacgcccggctaattttttgtatttttagtagagacggggtttcaccgtgttagccaggatggtctccatctcctgacctcgtgatccgcccgcctcggcctcccaaagtgctgggattacaggcgtgagccaccgcgcccggcccaaagatgacaattatatgtgtgtacataaatatgtgtgcacttgtactgagtaaaatagagactgatctcacccatacgtcaattctacttagacaaaggaaatcccagggtttttttttttttttttttttttttgtctctccataatgtgctattaaaataaaatgctattttgtcagtgcctttttcttttgctttcaatcctggactgtaggcaagacatacagtctcctcagagattgagaaaggtcaataatagaaatgctgttttcctcctttcactaactgattaaataacgcatgggcatatgtatagctacacgtgtatttctaaggaaaatcattcaaaaactgcatgatttcctgaggtgacctccagggtgctgaaaatttagaaaacgtaacatctaatgcaatcaataaaatcaagaatctgtgttaggcattttgagagttttggagtgagtgacagtacagccaattgatatagtccccgtgaaaggcaggtaaggcatctttatgtggctctctattgatgagaaaagtcttcctaagagaataaactagatttagagtgtgtcttatgaaaactgttgtttcccccatgccttcccagttaactcatttgtataattttggggcttcagctttgatggggctcctttatttgcaacatttagattaagttaatgactgttttatcatagctaagagcactagaattaggaggtcaatggctattagcatttgattttcttgatgataccaaagagatgagtttgagggggaagaagtgtgggcttgattactcatgttttaatttcatctcagtagacaaatccaaaatgatgtctcagggatgactcagaattccagatgggatatgtgtacttttgccctttgtccagtcctttgcacactgggcatatccactgacaacacaactgtcagaggaacaagctttcaatttccagtttcaagagggaatgagatcaggcttgaatgatcatttatggtgactgaattgctttctccgacaaggaagcctcacttgttcgtggactttacggatggtgctctcaaaaattggccagttaatctctttatctgttgcatctttcctagattccattgtgtctttcgaaaatactgtaaaatttacaaatgtagcttaggcaaaatgcaaatgtgtttctgtcttaaaaagaggaaatagctatctgcaacgatatgggatggagagaaagcgaacaggaggaccgtttagaatcatgatgtaggaaacataatgcaaaattgtaaggctggtgtgggggtatggcaaggataactagtgagagatccccaacggagatgtgaaatttggagaaaagcataggaactgcacataatgcaaagtttccttctctcactttgagctcagtgaatctgggatttgttttatgaacaaagatagcaagttgctttatgatggcagtggttataacaaatgcatgaacaaagtaacgggtaaacacataaaaaagaacaattgaccttgcgtaagggagagcaaatgtaacttgacttatgtgctaagaataatgcaaagaaaaagaactgagcacttactatgtgcaacacatatagtatgtactgtgttatgtacatgaggattatacgcttcatctcatttaatcctcactacaaccctatgaaaaaagcactactgtattattttcattctactgatgaggaaactgaggcatagtacataacttgattgaggttggcaaagcagacagaatctgacagaattgcaatttaaatctagagcctctgaactaagccactaaaatggactggctcagagttgaataagaataggaatttccaggtttataagggctttccaggcatagaaagagtattttcaaaggcatgaagctgagaaagacatagcgagagggccagaggccgaagagtaaataaggttgcaagggggtagggtggggagcagggaggaaaaaattctttttgaaaaaatgtgttgtagatatgaagtctcactatgtttcccaggctggtcttgaactcctgggctcaagcaattctcctgtcttggcctctcaaagtgctaggattacaggcataagccactgtgcccagccaggaggaaggaattcagttaagaggctagatcagtgaattggagccacatcatatatattttttcttttttagagatgagatcttgctatgttgccaaggctggagggcagtggctattcacaggtacaaccacagtgcctacagcctcaaacttctgggttcaagagatcctcccacctcagcctcttcagtagttgggactataggtgtataccactgtgcctcactggagctgaaggaggatatttccctgatcccttcgtgggtgggaactggaggggagcaaactccactcactcgctggtccacccctcatggaagggggagcacaggtgagcaggtgcagcagctggggccagcatttttgagtgctggcaagagtgaacaccgtacgggccctgcagcagcctctaggggagggtgcccatgaggaagtgttacagcgcccttttagctttgccattcacagatggcttaagtgttaacagctcagtggagggtcagtgtgacagcctttttcacccacacgcatggcacccaagttcttgtccagcatccaggaggaatgaggtcacatgaacaaattgaagatggtaaatatgggggattttattgccaatgaaagtggctctcagtgggaaggggagctgaaaaggggatggagtgggaaggtaatcttcccctggagtctgaccatccacagctggactcctctccaaagctatgctgtcaaactgtccctctaaagtcaagccgcttctctttgatgtccaactgtagtttctgacatccatctgcttctcctccttctgccagctgagctctggggtttttataggcacaggttggggggtgggtggggggtaatggatggttttggaaaaggcacccttcaagagggaaaacagggatgtaagttctcactttgggccatggttccaggctttttggcttgagggtgggtcctcaatggggacctgccctcttctgcccagaatttccctgccttctgtcctttatcaaagccacatcttgacaggctatggatactgacctggagggagagaaagctgtagctatagaagatttttttaatataatggggtactaggattagatctgttgtttagcaagataactagccatagtgataaagatggataaaagtctggggacagggaggctaatcattagaaggccaaatcattaatagtcactgagaaaggactgagggaagggcagagtagttagagaggaatagctggatttgagtgtttttatttttagatataagagtcagcaaacagaatttagtgaccaaataaaaactgaagataatagagaggaagaagtaaatgtggccccaaattttctaaattgcaatgacatcattaataaagaaagtaaatgcaaggtgcaaaacaggtttgattgtgatatggtatgtaggaaacacaatcatttccattggttgggccatatctggaatattatcatcagttctggatagcttatattgaaagtgtgaaaggaaaataaatcttggggcctcaaaatcaccaaactaaagggaaaagtcaagctgggaactgcttagggcaaacctgtctcccattctattcaaagtcatccctctgctcactgagatagatgcttatctgattgcctcctttggaaaggcgaatcagatactcaaaagaatgcaaccatttatctctcacctacctgtgacctggaagcccctccttgcttcaagttgtcccacccttctggatggaacaaatgtacatcttacatatattggttgatgtctcatgtctccctaaatatatataaaaccaagctgtgccccaaacaccttgggcacatgtcgttagaacctcctgaggctgtttcatgggtgcatattctcaaccttggcaaaataaacttcctaaattaactgagaccagtctcagatatttgaagttcacaaaagggaccactgttaattcttgcagaggaagataaagacgaagatgaaagtcttgactgagggtaattatgaggaacaacagagggaacgaaaaaaatcaatataattgaatacttttacaaaagcagttatttagagtgtataccctgaactcaagttctgttacacagtgggatatataacagtgatgaaagagccaagcttttcttagcttttcgacttagcaggacaatgaaaacaatcaaaaacccaactagttcacatcagcttgaaacgaggatgcttagagaagatacgaaaattgacaacgagtattttacagatgtagagaagtgacgtttctctttggctccagtgggcaggaatagatcaatatatagagatttcaggaaagccaattttcatttattataaagactttgaaacaaccagaactgctccctgggaaaagggtgatttatcatcaatgactgtactcaaactgggtttgaatgaccaaactgacagggattttatagggtcgaatcctgccttaggaagaaaatgaatgattcttaaatccctttaaattctgagattgcatggcagaagcacgatgaagatcacactacctaaaaagagaggatctgatttcaggtcctagaagccttggttttattggcccttagtttccatatctatgatatgagtttagatgagttatttctaaggtttcctgttgctttaaaacattcaatgattttagagttgcttgatgtcgttagaaatattgaatgccagaatgtggaatatttatttaattggataagaaatagaaaaactttgttcaaaaattttaagaaacaatcactattaaagctgcacttagaggctatttatctgcaacaatgagtagacgtaaccatgtcagctaacatttattaaatcctatttcagctagtgagctaagcacctgatataaatgatctcatttaattctcataacaaccctgtaacataggtactattcacagtcagggaaaccaaaccttggagaggttaaaacatttgcccaaggttacacagtttctaagtggtagagaggattcataccctgacagctgtcaacaggaattaatgaaagttctctgtaaagggccagaaagtaaatatttctggctttgaggaacacataaatctccgttacatattcttctttgggtttcgtacaacttattaaaacaagtaaactgtttttagctcccctgctattaaaaaaaacccaggccccatgttgaatttgtactgagacctgtagtttgctgtcccctgctctgctctcttactacaacaccctactgcttccccaagactactatttactgaggacttcttatgggccagacactgcgctaaatgcttttcatgcaatatctctgtaatacaacgagcctctgggttggtttccattttatagatggaaaataggcttagagagtttcagcagcaactgaaacacaaatacaaggctagaaagtggcagagctgtgagctttgtgaatctggaaactgtgattttatccattgcagtagagaggctgagtagagtgaactgggactggggcagggagggactggaataagaaaactggtgtgtagagcatggcaacagcctagacaattatggtatggtttgaaaaacactgtagcttcataatcaactggatttgtcagtttattggatgtcaggcagggtggattaggggaaggtcactctaaggtctgagcttggcttacttagagaacagaaataaggaaatcaggtatagggctgctttgaggagataaacggatgggccgataaagcttatggtggcaagatcccttatagttttggctgcttcactaactagttgtgttatggcaggcaaaaaaattagcttctcttggcttcagtatcctaaagtacaaaacgagggtgttgaattagatggtcccttagtttacttctagtgataatgttccagttggtgaaaagcaaaggaaaattctaggaaactgccaaaagaaagagcctagaataggctttttgagggaacgatttctgaaaaagaattgaacagaagggtgctaaaaagtttattgtaattcttctgtcttactgctctcagcaaataaagatcaaacagggtatttgtgtttgcaaggtcaaagtaaactagtgtccattatcaaatggctgaatgactcttaactggctcagagaaagatcagaaaatgtataggagaaaactaatggaaagagtgattaacgtgatcgtttctggctccaaagaataaggaaacatgggaaatgaagaaatatgaagaagtatgaggcaagaaataaagataatataaatgaacaggtcactatgattatttgggttgcctatttagacaagaaaatagggcatcgataatctctcatgcctcctagtacaattggaaaagaaaactaatgctagtatcactaggaaaagacatagaagaattacttttagaatcatcaaaaaataagtttgaaagcttttgcaaaaagcacagaagtgaatgttttgaagcaaatgaaactaatgggaattataatgagacacatagcagttttataatcttgcctctcttgtaatgtgtcagagaacaagaaccctgctattttaacacgctttgtctatacggtgccaacactgaacttgacacgaagagaagaaagtcctttctgatgagagcatgtagtatctggatctgtttctagactatgtgattcattttaaagatttctaaggaaaggacacatctagatcatctatgacgttaaatccgctgttctgaaataatatcaataatacaaacaaattctaattttatgtatgtgaaaaaaactacttatataaactcatattcattcgagaaacaaatactccaagttggatatcaaggagtttcctttcagttatcctttgttcagtggatataaatgctgtgctccttaatactgggtacaaaaagaaaaataagtttattagaaatatacacatcaaatacacttctgaaaaaaatgagaagctattgaaatgaggtcaactaaacagaaatctatttgtagggtttaaaacaccatgaatgagatcatcttttgtgattccatctatccttgcatttctcaaattctattttgaaatcactgcctatgttcattgcctaaaatagcttttcctttgattcttagatgatcttatgaaaatgaaaatatatataaggctattttgcatagaaatgattagacatagataaatatttacaccaaacagtttagggagtggggactagttatttcagagattatacaatgaaaattttagactgatttaaacatattattttatatgccagtttaggatgatgaataagtaatgaatcactgaatttctccctcccttcctacccccagccttcttcacttctttcctcctttattccttcatttctttattgacatacatacgtagtgtgtacaccccccatcttctaaagtaaccccatgggaagaaacgctcaggtggttatattaaaaaaatcgagggtatgaaaatctcagggtcgtatgcccaaacaccaatgcgatataaaaattaaggtgcacatatatgatttttcaattttttcatttttatgtgtgaatgaatttggaagaaaaacctttcatacactccagactttctgtgttttgtagccacagccttcatttgcaactctgacatggcaagctgctgttttctagatttcatttgtgtgggcgcctgctgcacaccaatatatattttctctttacaaccatccaccatgtggatgcatttctttattagtcaatatatattctgtaggttacattctgcaaatttgaacatggacaaaatgcaatcaatataatccataacactgcacagatgtcttggagagattgcagaaatcattcaccaggaggctgaatgtcgaagaattataaaattgcatttagatggacaagtcagaaaacaggtttaaaaagtagtacatttttaaatttgtgatttcattatgaccatggaatgaggtaaaagcataactgtagtcagcaatttacacttaaatacagaaaatgcaaaagacactatgtacataggaggaaaggaggtatggatgtgagaagaaacaggagggagaagcctaatgaatgatcttcagatgaaaagaatcaatgaaaaatatccagctgtggttaaatgctttcaaattgccatttatgcaattgatgcatggaataggtatttgtcagtgcagagagtgcgaacagaacattattatgaaacagagcaggatccttggcaaaataccaatgaaatacagttttcaatagtaaggaaaatggagagtgtgaaataatgtcaattagagagaaatgcatgctgctgaagactctcggcactattcctggaagaataaccaccatgcttagaaatccggagagttctgggaaacaatggccacagaaacaagacttattgatttaaattaagatttcagttgtgcttaagaaacatgtaatgactacaattatatcatctgacaagaaaaataatatgtataggcaagagtgatatttaaaatgttgtacttaaccattcgtatcagatggatacagaacaatcaggcacaggcaatgaaaaattagaacagaattaaaaggtttaaaatggaaagacatggatgtattggaacatactggctgaatatcagtgcctgagggcaatggttgataaatctgtaagaaatttttcaatgcatatttctgagcacccttttgtccctttaatagaatgataatttccagcaaaatcaaaagtagtagaaataaacagttcaaaaatcccaacttttaaagaattaccttcatatgacatttgccaaacccctgacaaccatctataattgacaaaaaaaagcgagcataagttgactcaaattaataagaaagagctacaaaatatttagaaagtaggaaaaaatctaatatttaaaaaaattctgcctaaatcacctgtttagccgaagttcagaatagtgaacaatcagcaataatagatgtaaatcaatttccacttatggatgtaagtgccctttggaaatactttttgaaaagttaagagaccacagtggtaaaccatatactaaaagcaatctatgacaattttctaaggcctctgaaattctatacaggttctcaaaagtactattcagaagtgaaagttccaataatagatgctttcaacgatattaaagcaaaaacacaagaggggaacaatgacagatataaaggttttatacctagaaaagacttaatagctagacgttgtcacaaattactacactaacaaacagtgcatgaatttcagcttttcaacttaacaaaagatgggcaatatagtcaaaccatcatttacatgagctcttgaggcttgaacatattaataccaaattagaaactaagagcagattgtacccatacattcaatacagagttgctgaatatctaagtgcaatgtactgtgttagaagccataggaaatatcaatgttttttcaacatggatcctaattttaagatatgtatagtatacttggggataatgaaaatacgagtaggcagaaaagataactattgagtactgggcttaatatctgggtgataaaataatgtgtacaacaaacctccatgacatgtgtttacctatgtaacaaaccttcacatgtaccgtcaaacctaaaataaaagctaaaaaaagaaaatacaactagaaaagtaatattattaatatgagaattaattattttcatatggaggaatcagggaaggctccatgatacagcatggtcttgacattaagagtttgtggaattggtgttccaggtagagaaaataataataatgacaataataataataacagtaaagacagtgatagataacattattgtttctgatacccaataatctttgagttatgtcattttcattctccaaaagcctcacgaagttggtttttaattccattttacagatgaggaaactgaggcacaggaaggactcaaggttatatatctatcaatggagtggattgattagaattggatctgtccaattgcagagcccctgttcctataccgccttttcataaacagatcaaggtcagtttagttggcatgtagtttgtaaaagaaaggagtagcagttagactagaagggtgacttggagtctcctagctgcatttacaaaggcacatttaaggcaccctaatccaaggcatgttcatttccacaagctttaccacaattttttattaataccataaacaccaaaagaatatagtgccatcatcatagaaatccattacattaagtcatcaatgaaaagtatactcagaagttcttgaactctgctcatgaaattcagttatcttttgaatatcataggcatcatagaaaaatgcatgaagtttcaactacatcttacttgtgatactttatcttattttttattattattttatttcattttatttgagacagagtttcgttcttgttgcccaggctggagtgcaatggcacaatctcggctcactgcaacctctgcctcctgggttcaagcaattctcctgcctcagcctccgtagtagctgtgattacaggtgcctgtcaccacgtccagctaattttttgtatttttagtagagacagggtttcactatgttggccaggctggtctcgaattcctgacctcaggtgatccacccacctcggcctctcaaagtgctgggattacaggtgtgagccagcatgcttggccctttttttttttctttttttttttgagacagagtctggctctgttgcccaggctggagtgcagtggtgcaatcttggctcactgcgagcttcacctcccgggttcacgccattctcctgcctcagcctcccgagtagctgggactacaggcacccaccaccacgcctggctaattttttgtatttttttttttttaagtagagatggggtttcaccatgttagccaggatggtctcgaactcctgacctcgtgatccatccgcctcggcctctcaaagtgctgggattttaggcatgagccaccgcacccgatctatcttatttttaaaaattatcactcaacgtacagctcaaatcatccatagtataattttatttagctgaaggatggatttgtcattagttccataactcctgttctctctcttgactttattttttatacacacaacatttaaccagaagacagacccaataaaaatttattaaattatgaaacaggataaaactggacataatgagacaaacaaacaaacaaacgcaaagtggtctaaaatgtttcgatttaatgatgatagcgtaacctgcaatcattcatatatgagagaaggcatcatgaggatctcagctttgggataggttttccaggaagggaactagagcattagtccagccctgttgtttcagcaaggacccctgttagcaatgacaggcatttataagaagtgaggccacactcatcaggtgcagagcacagcaaagctgcatggctcactagagtactgaatctggcatcacgctcatgttatccacttagtaaccaatggggcagttttaaaaaccacaaatgtttgtagggatctgttttctctattaagcctctttctcctgcgaaacatatctcctgaagcatggagaaataacttatttttctttaaactttttttttttttaatttgagacagagtcttgctttgttgcccacattagagtgcagtggtgcaatctcagctcactgcaacctctgcctcccaggtttaagtgattctcatgcctcagtgtagctgggattacaggtacgcaccatcatatccagctaatttttgtatttttagtggaaacgaggtttcaccgtgttggccaggctggtctcgaagtcctgacttcaagtgatccgcctgcctcggcctcccaaagtgctgggattacaggcgtgagccactgcacccggcctctttgaacttttttttgttttgttttgttttgttttgtttttactggtttatcttactacttttattatacaatgcttttacaaaaaattttattattattatacttaaagttttagggtacatgtgcacaacgtgcaggtttgttacatatgtatacatgtgccatgctggtgtgctgcacccattaactcatcatttagcgttacgtatatctcctaatgctatccctccccactcccccaaccccaaaacattccccggtgtgtgatgttccccttcctttgtccatgtgttctcattgttcaattcccacctatgagtgagaacatggggtgtttggtttttggtccttgtgatagtttgctgagaatgatggtttccagcttcatccatgtccctacaaaggacatgaattcatcattttttatggctgcatagtattctctggtgtatatgtgctctttgaacatttgatcttggtatcttaatgttatcctttcccatccaaggaaaggtatctagcccattttctttgcgtttactccctccagatgttctaatgtctgctccaaaatgctgggtgaccccatcctagagctgctcacatggtatacaggatcatagcacttttgcttaagtgaattgacttatttcttgtaagtcatgcccagcagcattaatacttcctcctcaacacaaccacaagagctctggagggaacccctcctttactacaatgggggttttctctgctttccagtggggaaatgggggcttctcccatgatttactagcctctcaagactattgtggcaatttggtaagataatactttgaaaatgctcagtcaactctaaagtgcaatgcagatataaagtataagtaatagctactgaaatattttaaatatccttgggccctaatacaatcatgataaaatcagcagtcttctacataggaacaaataaaacagattctccccattaagtaaacaaaacttagggtaggcttgaaaaaggacaagttgtgaaattaaatttccagatttttaattcaatttaggtgttttctggtgccagatggtttgaagttcttaaaccatttttattttattttattcatttatttttttgagatagatagagtcttgctctatcgcccaggctggagggcagtgacacgatctctgctcactgcaacctctgccttccgggttccagagattgtcctgcctcagcctcccgagtagctgggattacaggcgcccgccaccatgcctgactaatttttgtattttttagtagagacagggttttgccatgttggccaggctggtcttgaacgtctgacctcgggtgatctgcccacctcagcctcccaaagtgccaggattatagacgtgagtcaccgtgtccggcccttaaaccatttttaaagcggcatgcatctttaacctttaatgtaaagaacatgatcatagaaaagtatttaaattttgaccttattcatgcaatgcaatgctttaaactgtagatgtcaactttgcactctatgaccacaaaatatgcacatatcacccttttattatagaactcggtaccactaggtatgatataaatggttactgagaaacagagtttgctgcatcgtgcttctagtgagaaatagttgcacagtatttaaggagttgttcattatgtaatgggaactttgtgcttagaacagctccacagggagaagcaatagagctagatgtaaaaatgttctccatttcacaatgtagaagtttaatttttgcagtatacttttccttatactatcataattttacatgttgggtaagaatttccatgaattctatgtacaatttggcctcctgtcatctttgttttgccctctccctttctcttatagttggaatgaaacagaggaaggagtagacagtatggcctttttctgattttgacctacattacattttgagagtttagagtaatggggaccatataataatattaatcaatcgataattatatatatatatttatatatttatgagatggaatctcactctgtcactcaggctggagtgaagtggtgcgatctcggctcactgcaacctccacctctcaggttcaagcgattcttccacatcagcctcccaagtagctgggactacaggcatgtaccgccatacctggctaatttttctgtgtgtgtgtttttttttttttttttttttttcagtagagacagggtgtcaccatgttgcccaggctggtctcgaactcctgacctcaagtgatccccctgcttcggcctcccaaagtgttgggattacaggcgtgagccactgcacccaaccccgataactttttctgtgtaagggcgtaggtactttaaatgcaaagtgagaaatgcagtattaccagggcagaaaaacatgctctgtgaacttatgtgaattcattattccttacttacaatgattgttcacatccctgtagtaaagaaacttctctacttacaacttcccataggtagcaataaaggtcccaggcacagcagaagcatggcaatgaagaataccaccaacagaggacatcagaacttactttaggccaccattaggttttcttagcctgtgttgtgttttgtgtgcatattttcataatgttttataaatattattattaacaccgctatgttcaaaagtacaaaagagtcaaaaaagtgttcctttaagaaaagacatgcgattactacggcaacaaaagagaacttattgtagaagggtgtacattgtatatattggtcacttttgtatgtcattttggacttaaaaggaaatgaatttccaaacagcccttgagaaccaattctctttgtagagaaaggaggttgtatgttgtctataaattataggatcatagactctttttgtttgttttttgagttagagtctcactgtcacccaggctggagtgcagtggcacgatctcggctcactgtaaccttggcctcctgggttcaagctattctcctgcctcagcctcccgagtagctgggactacagttgcctgccaccacacccagctaatttttgtacttttagtagagacagggtttcgtcatgttggccggactggcctcaaactcctgacctcaagtgatccccctgcctccagagatgatctggctgggcgtggtggctcatgcctgtaatcccaatcccagcacttagggaggtcgaggcgggcgagtcacctgaggtcaggagttcgagaccagcctggccaacacggtgaaaccccgtctctactaaaaatacaaaaattagccaggcatggtggcgggcgcctgcagtcccagctactcgggaggctgaggcagaagaatcacttgaacccgggaggtggaggttacagtgagccgagatcgcaccactacattccagcctgggtgacagagcgagactcttgtctcaaaaaaaaaaaaaaaaaaaaagagagagagagagttgataggatcttaaagtttatcttgtaaaattcccaggtaaaagagtaattctctgtaaaacatctttgtgcaagtactgttgattgtccccatatattttccattttttcttgtggcaatagaactcataattttcagttgggtatgtagatgcctgaaggaaagaatatatttcttagcctcacatagatgtaaatataatcatgggacaaagttctggtgaaggaactatcaggggatacatttcatgacagtttctgaaagattttctcacaacactgctggcacacgccctctctgtgcctccttccttcttccatgttgctgggggctggaactcagatgtgttggctggagctgaagcagacatattggaccatgtggtgacaacgagaattgaggccaccatggcaggacaaggtaaaggaggacttcggacttagtgaagcagaatagcggaaggaggcctgatctacctagttctgggcttgtacatgagagagacctacatttctctattgtttaagctattgttacagtttgtcctattagcagatgaatcagattaaaaaatgatggaaatttgtgaagcagcccatgccacttaataacaactctaacgtttacattttccttactcagagtaagctccactgtaacacttgcccatagttctcttctacaatcttacttaattaagtgtgctgtgtcctttacccaccctccccagatgcatgaagaagctgtcctgtattttcatgttatcttcttactgaacattctagattctttcaaatatttgtcatataaccatcgctatacctttcacaatcttggttgccctgctgtcaatgtattatgatttttcagtgttctcatcatacgtgatgctcataagtcaatatgactgcagatgtggtttaactagtgaagagattaatggaacatttgtgaatttcattaatgcaatctaatactgtattgcctcgtacagtaagccacaccagatcatactggagattaatacagtccttgtggttatttaaaatcccaatttgtttttcatataaagcgccacaaagtcagatgttcctcagcctatatttgtacaaaagactttaaaaatcttaaaggcaggacatcttgcttgttcttgttaaattttattttaatttttttattttggtacagtatcccagtctgttataatcttattttgagtcttgattttgatctttcagtgtgttgactcccattctcacctttgtgtcatttgaaaaattaataagtgcacaatgtatatgcttatctagaaaaatgacaaaaatctgggtcaaagtacaggcaaggaggcaccacttttagggggcactatttatggagggttgtgaaatgaagtagaactgaattcactctgtggttagcaccacaaaacacttctcaaattgacagtttaacacaacattcctccttgggcatggttattgaaacatcaccaaatttaccaaattatatttctctccatgtataattcatgtagtttaataagattgtgagcagccacgtaaaaggcactgctgaaattcagatacactgctgcagcataacaccactttaaaaaagccagttaagttggcaaagtaaaaaaaaaaaaaaagcctacaatattaaggtgaaaactttacaacatgactctagtgaatattaaagtctaaaataaaggaaaagaaacagttgctcaatgtttccaaatacggtttctcccagatttatagttttctttatttctttattttattattattttttgagatggagtttcactctgttgcccaggctggagtgcagtggtgcaatatctgctcactgcaaccttagccccctgggttccagcaattctcctgcctcagcctcccaagtagctgggattacaggcatgcaccaccacacccggctagttttttttgtattcagtagagacagggtttcgtcatgttggtcaggctggtcttgaactcctgacatcaaatgatctacccacctcggcctcccaaagtgctgggattacaggcatgagccactgcacccggcccccagatttatagtttttaagataaaagcgacaagccaaattaatgttttaaaaagctcgaaacatatggggggaaaaattaaacaaagtgccaagtagtgaacatacagctaaataataaaaagtagtcatactgatgctttgttattcaaaaatcatttttcctcaaagagtaagggtgaaaaattgtaaggactatcccactacatgttcaattaaatgactaaattaatgtagagacatttaattaaagttccactagtttttccaaatgctattaattacgccgctatctaaaattaaatctctccccaaacccttttacatttcttccgctcatctgatacagacataattaaaatgctgcaagtttacctaaacgcatccaaatattataaaagaaaatatgaaaaactggagtttcagtagctccttaagaagctggaattttaatgggatttctacaatccttggggaaaaccaatagatgtgtaagcaggcatgcacacacacacacaaactgtctcaagattcctctgaaaataaatttctctctttatatctaaggtgctgcagtgaataccacagacaactatagtttcaaaggttttctaccagcaaaagacaagaatttttgaagacactgggtaattaattgcaggcacaaggtgtactctagttataacacttctgtgctaccattttcgaaacaataagcattccttaatagcggctcagaaaggcactctttaagagaaacagtttggaattcaggcttccttgtattgtatccaaacttccaaatggaaaaaaaccagcctggacaatcccagcttcattctatatgcaagttattctccagtgagtaaacaaaggttgatcctaactcccaaacttattttattaatcatatacaagatgaaaacacattgatcaaacaaggtctactaacatgagacttctcttatttcctttctcttacttgattctgacagttgtccttttaattgctctgcacggatagtattcagccatctaaaatcaacaaattctctatttaccccagtcgtcttccagattgctgtaggttcattatgcaaatgttcctttaagaaatacagagttactccaggaatgaccactacctgccattactatggagtccagaggtagggtcaggtacaggctggggtcttttgaaagtgacttgtctcttttccaaaatttcatttgcttctaatcaagagtctggtaaattaggaggagtccttttctcactcatcatcgtagccaaagtctcatgagacaaggctgggtctcagtaggactgtgattcatgaaaagtcaattatggataaattttgtttaccaatatccttcctcattcctggttctgcttggcaaacagccatccctcctcccattctcttattacaagggtttgcaaacttcaccgcactttgtaatcctggggattttcaacaaatgctgatgcttggagcccacccccagagattgaattggtctgagatgcagcctgggcatgaggagctttataagctgcccaggggattctgatatgtggtctgcgctttaggcctgtcaaggtgggataacaacttgataataaaggtttatttcctgatcagttaaaggggttaccacatctcaaagaaatattttgcatactcaaaggacctgtaatggaatttaagttaaataatggtgttacaatatctgtaattaattttaaatatctcaacatagatagttggatattttatatgtgcagttagtgcaaccttcaactctagaggcttgaggcaaatggttattttaattaggaattcatattctaggacagcacagccttcatcttatgaaaaaggccaaaacccagagactgctactactatatatctctgtgaaccttggaggattttgtaatgcatgtaatagatatcgcaaatgtgtttttgctgagggaaatagtggattgcaatgaatatccctataggatctcattagtaaaatttaagacaatcaagatacatggattaactaaaatattttaatgacatcccctaacattgcataaacaggatataagaatccagcaaaacctgttgcttgggcttttaattttacgtctggtctccaatggccttgtatccaaccattggcttaggaagaattcttgtgacctgatgccaaatctaaaggtaagagaatactgtatttgcaatggtgtcaatttaagcctaaaatcctacacttcataaaaattgtagaacaggctgtaagctgacttctgcctgccttctaacaaatgttggttaacgacatgattgcacttgtggaggacttcagcatgaagcatgaagctgcggcttgaggtagccattcctcatccacctcaaacacatctgtggttctccattatttcccaaaaagaacctaatagttgcacgtgacctaaattcacttaggtcagttcacagcaggtggaatttgaggcagtgtgccaataaaatgagcggtaagtaaatatttggggtaagagggtcttctgcacaacgattaaatagttctaggtgattttctaatctcctcatttataagagtggtcccagcaagaacagagactgaaataaagtggtcgtttcaaagctttaaatactctgctttcagctactctgtccacttattcaaagacaaacttgaaaggaaacaggagcccatattatagcacaggcttttaaatttgtcaatatgaggaaccaggaaatgccctgttcttcttcggggctctttcatttagcttgcattccaggaatgttcatttgttccaagcaacattagaaattaatggggtaagtgctgggtgaatgtaggtaatcggtataaaggctgctttcttgagttaatgcctgagaaatcaccaagcctataatttcttttttcttttctttttttcttttttttcttttttttttgagacggagtctcgctctgtcgccaggctggagtgcagtggcgcgatctcggctcactgcaacctcctcctcccaggttcaagtgattctcctgcctcagcctcccgagtagctgggactacgggtgtgcaccaccacgcccagctaatttttgtatttttagtagagacgagtttcaccatgttggccaggatggcaccaagcctataatttctaaagtcctgtttcatttgaagtttgaatgcaaaagtactaatgactgcaggggagggatgttttctatatcttaagaaatacgtaaataatatgtggcatagcttctgatagtactgcaatataactatctataactaatatatacagcaaatatattatcacttcttttttttttttttggagacagtttcactattcttgtccaggctagagtgcaatggtgggatcttggctcactgcaacctctgcctcctgagttcaagtgattctcctgcctcagcctcctgagtagctaggattataggtacccaccaccatgcccggctaattttttgtatttttagtagagacggggttccaccatgttggccaggctggtctcgaactcctgacctcaggtgatccacccactgtggcctcccaaagtgctgggattacaggcgtgagccaccgtgcctggccctattattactctgcatgtttctgcagagatctgtagaaaattaaaaaaaaaaaaaaaagaatgctggcttataaatggagtagattttctggaaaatgaatgttttagtccgttggaatgctataacaaaatatcataaactgggtggcttatagacaaccaaagtttttttctcacaattctgaaggctaggaagtctgatatcaaggcgctggcagattcagtgtttggtgaaggcctgctttcttgttcatagatagcaccttcttgtgttctcatggcaaaaagggcaaagcagctctctgggtctcttttataagggttctaatctcattcatgtgggctctgccctcatgatctaatcacctcccaaggggcctacctcctaataccatcatatatggaattaggtttccacatatgaattttggggagacacaaatattcaagccacagcagtaaggcaatcacaaaatagggcagttagatttaagtgtaatatactagggaatgacaatgagagagatgtatcatcaatttctttgccttctcccctatcatcagggaaggtacctaactgctccaaggccacatgactccatgcgcaccaatagcaaaaactacatccaatgctttataggttaggaaagtacaggttcccacacttatatgtgctcacttccatttcttgctgcccctctctttatttacgaaaggatgagaacttgatccacaagtgatttcattgagatgtaactcttattttatccaaagagaagtgttggaacatgctttgattatcaggtgagggctctgtgcacattttcatgcaaatgtcttagattggtaactctcctccaatgaatgcaagaccttctgccttcggtgatgactaaggtggtaacagttatcaggtagttgcttggcactgacttatttactagacattctttttttttgttttttgtttttttccagagagtctcactctgtggcccaggccggagtgcagtggcatgatctcagctcacggcaacttccgcctcccgggttcaagcaattctcctgcctcagcctccccagtagatgggactacaggcaccaccaccacacctggctaatttttgtatttttagcagagacacggtttcaccgtggtggccaggctggtctcagactcctggcctcaagtgatccacctgccttggcctcccaaagtgctgggattacaggtgtgagccacattgcctggcctactagatactgttaaggcaggcatgtgctaaacaggtcacatgacctctactatccctggaattataatactagttagaacaatagttttcaaactttgaccatgacctacagtaagaaatacattcatcatagttacttagaatacattctccacacgtatacattcatgggtgtatgtgtgtgttgtttgtctaaaataccacttccccaggaaactttccaggcctactacaccaggtcaagtccctctgttatactctctcagcactctgcttttgtcctttctaagtactcattacaattggaatgaaataattgcataacaaagatgttgaacccatctctagatctgtattctagggctttctgagggcagggaccttcttcctctcttatagaacagcagtataggaaaaactgacctgaagcaataacattttgcacataagagctgcttaattagtacttgtgacctgagtaaatggataaagacctcagcaaggagatccctgggtccttttcttatttggaaatcttgaggtagagctggagtaggtcatccaacatgttcattggcatagcttacagaacaacagcatcaacatggtgccaggacagataggatgtatctggggagcaaggtgtgatacgagagcgggatgtattattaatagttctaccttttctcattattttttcagggcttgaacatgtttcttgttggtatccactcatatttattgcctctttcttcatctcatttatttattgtgtcattaccaacttaacccagttttatttatcttctttttgactgcctgttggcaaaaaaatatcaaaacttaagaaaaatgggtgttttctagaaagttgggtaaaaatacactattgttttgttgcttaatttctttatgctgccttgctctgtgaacaaagtagaaaataatacatttattttggaaaataagctcaataaagacaggagttaggaaccgtcccttgactaactactgagggaaagccctttctatagaatagaatttacatcctgtgagttggtcatgtttttagtaagatggattaaattgcatgtatatgtccagagtcaattaatgggaaacatagaaccagaatccaagtcaattttgtccattacttctttctcaagagtaaacaccctcagctggatgacaaataatgattgccaggcaaggtttatgttattacctctacaagtaggaagttgatgcaaagcaaaactctcacctgacatctgttttttttaatcacccttatagcaagttagttttaaagaagtgagaaagacatgcgtgaacaggcaattttgctcccagatcaaacttcttcttataaccagacgtggcttcatgttccagcaaagcaagatattcccaggccataaggtaacaaaggcctgggacactgtggtgtccacatttctcacttctatgaatgagtgcccacaggaatgtgttcataacatgtaacaaagtcaacttgtgagttgctgatacacatctctcttatgtcatacaactgctgccattagcgattcatggcagtgtccttgcccggcagtcatgcatatccaaatgaggcatactccctagctattacaagagtcctgtctggctgcaggcattgactgacttctcctttttatctcaacttaaaatcagtgccttgctcccatccagtgccacatgaaatccaaggaatcaaagtgtaatctccgctgccactcctcatgttcaaaacatggaccattatgcaatattaaagcatgaatcctggaactctgttaatgttgtgaaataggtgagtagttagcaagaattaccattctgacagtgcagtggaaaaacttcattcattgtaaaaagcagggagttgagtttctatatggggttgcctttcacgtcccctccccttgcagagataatgaaaaaatgcccagctatttttcagatgtgatgtttactttcttttccaagaggttctttggaggaatacacagaaatattttatagaaccacaaaataatagaggtaaaataagctttggaataaaataagcaaataagactagtttctagtctacgatttctgggaaaatgcgagaactttagttaaacttgtttattttattctaggtgaattttattaacttaaaggatcataaaataataatgatcatctctacttttaaaatccacatttctatcaattattatatgcatattccagtgtgtacagataaaaagatattcaagtacaactaaacctagagatttcatcagaaaataatccccaaaatgagctgctattgcaaaatggaaaatatgatgtaaacaggcattttgggctttcagataaacagcataaatttttgaacaggatacgtcttgttttccacaaagagaaaaacaaggtgtagtgaagagcgttgaattgtgtctgatttctgatcttgcttttaacaaatgagaacgtctcagctaagtcaaccagaaactatttcctaatctataaattaaagggtttggcctagataatttctagtcttttctggcttcaacccctccctgcttactctctctctctctctctctctctctttctatatatatatatacacacacacacacatatatatatatatatatacacacacacatatatatatatatatacacatatatatatacacatatatatatgtatatatacacacacatatatatatatataaacacacacacatatatatatatatatttttttttttctttttctttttgagacagagtcttactctgtcacccaggctccgggttcaagcaattctcccacctcagcctcccgagtagctgggactatgggtgcatgccaccacacccggctaaatgttttttgtatttttagtagagacggggtttcaccatgttggccaagctggtctcgaactcctggcctcaggtgatctgcctgccttggcctctcaaagtgctgggattataggcatgggccaccgcacctggccagattgcaggtatctttaacaggttggagtgttacctgaattttcatcaatcttgggaaacatatagctgctaacagttttaacttcctactctatgtttaactcgtttaacatattaaaacacgcagacaatattaaactgcagcaacacatggagaagaaaagcatcgtggaaatggggtaagatgggactctagaagtgtttaaaacctcccatgctgaaattttaagtaaatgttgacgggcaatggttaaattgtaaaataaatgaatttgttgtcactgaaatttagaatactcctacctcttcttatgttttgcccttttaagatacaaattaaaatttttaaaaaatagaagagctcagaaataaagtgatggggataatatgcatacctatactaccacacttttcctttcaccagttactttggaaagtatcctatggagttttgattttagtagaattcatgtgaggcaaaagatggcttattatttctattgtgtaaaatctccaaaccactgggcagttataagactttttttttttttaagctcaaacacaggtcaaggctataggtgggagttcttgaacaataaacaaagtgagaaatggtcttaattttttgttattgctgctttgaatgacacacagacacatgtactaacacaggcaagactcttgctgcacggatatatgtatttttgtagaaaagatcaaactaaaatgaattcactgcctggcatcatgttttcatctgccttccattttccacaagggtgtactccacttgcttagacttaggcaatttaaaaattcttgatcttaatgtcctctaaaatgtacagactttatagcttagattttaagagacaccattacctgacagggtaatgacagttttatttgcactggtgactggatttgctgtgatacttaagcaataatacaaataaaatgataatttttttgagaggatgtcagggaaggagaaagaaaagaacaaaatgcatcgcatttaacttggtttaaaaacacaacacactgcagcttcccaaagcttcttattttactggaaaaaaaaatcccttagcaattcatcttcctttgggcgcatgaatgacattttactgtgatgtgattataagaaacaaaatccctcggagatgctgccttaaaatatttttctttataatgttctgagctcgacaaaccttggtagaaaacagaatactcttaattatgaataaattaactaaattagtaacatgagatggatatgcaattaagggattgttaattgaaactggaaacacagctgtatacagcttagagatgaatcataccagtaatgacgcagatgtttataaaatgtgattatctttagtggagacagcgctgcatctcccaagcccattcttatattgtgtcactgaaatggtttttaaacccgtgaacaccaggaatcaggatctcagggacggcaaattaggctccctggatatgggaattagtgttgtctgaatgtcagcaatttgattctccagctttcaaagaatgtagatatggagccaacaacaaacatctgttagttgcatggtcttcaaaaaaacaaaaacaaccaaaagttgctggcaaaccagtccctgcttcaatcagagaagacggtaaagtatctgtaaacagtcacactgctgtgtgtgactgttagaaacatatagaaaagagaaccccagggcacagtgccagagaccttatgcacaaatggtaaatgccccctctgctggcagaggctctaaaacattttctgctcttttcccggcagtgaacccagaagaaaaaacaaaatcttcacaactaaggaagcagtaggaaaatgccgtcattacactcactgtatgttgaaatgtactaaaattatcaatattctgttgcactttggaaacttccgttttttgcttatccacaccattttcccccatgtgcaattcccatttgccccagggaagggaaatgtctctatggttctagattttaatcgagttacatgatctctgcatagactgtgattggacaaggttgaggggagactggatactgtgtcctaaccatagtttaatgattatggaatgaagggctcagctacatagactagtctttggaaatcaggtttttggtttctggacaaagcttgtggcattattcaaaccaacaactattaggctggatggtgcttacaaagatggaagatggtagacatcagttttttacgtaaagtgcaaactaaccactgtaaggtgtagtcaaaaaagaaataatacataattttagatattgaccaacagaagatatatttgtcaccttagcttagcttctctttcaaaattatcaatgtccttaacaaaatctagtgctgtaaaggaaaataaaacaacagatagtctgacattagttaatactttcctctatcaaaaggatgcagaaaacttagggcatcctccttgaattcaggggagaccttttactacaacgtttaacgaagtatttggatgacttgaggctcaaataaacaactcagttttccactgtgttgactgtgggcatatggggtgtagctgagttgtgagtctgttaaaagaaaatacactttcaggaatgaataaggagaaaaacgcaaacacataaaaagacacaccactatatatagttttctctctatgttggatacctataaatgtgggatttgttgaattttgatcacaaagtctttctatcctatgtgttagtctgcacaagtacaggctttgcctataatttcagtattgatttgctgttatacaggttccaacttgtctaaatttcattacctgaagggacagcttgcaattccatatacaggtataataaaagcaagatgagtacatgcatactgtgagctctgaaaaggcactttttctacaatggctgtgccaaattcttcatgagactgttattctgttgcaaatggtgataagaaagccaatatcatacattatttactagcatttgtactaatattttcaattctgaacctcattataatcacacttgtttcagaacccatttgtggacatacccagctatttgcctaactaacagctatttacttcttgttccttggtaaagaagctcaattatgttcagatattgggcaacaaaggacacagctctgaggaaaaaattaaaatctggtctaagccaatcacagtaagcttgtttctcatagccagtgattggcttaaagaggttcagtgagatccagttctagttgacacataagaagaaatttgttggggagcttctgggaaacgtttgcttttccaaacacagacacacaggcatgagtacacacacacacacacgcacacaatacagttatccttgaaccttattccttcttgccttggttattgttgtctgcggatatgttgcttggcgcagtgggaagccatcttgggaccatgaggaaaaagacaagagaatcccagagaagctgacctcaagtcttgatatagctaatctgttgaattaaccagctctaggtctgatggtctttggacttcagtttattttgattagtggttctcaaagtgcagttcctgaccacaggagtagcagcataacttggcaacctactagaaatgtagaatctcggactccacgctggacctactgcatcagaaacgctgggagcagcctgccagcctgtagtttaacaagcccccaggggattctgatgcatactaaagtttgggaactgtgctagattatcaaatgtctctattatttctaatgtgtctattattaacgatagggttttcacttcttgcctgattccactggagttcgtgttaaaaaaaaatatattcccaagtctattgcatcagaatctccagtgaaggggcttgtgaattaataatttaatcaagtgcccctggtgattcttatgaccagaaaaccttgggaaagacaaacttaagaactttaaagtcaggtatctgttactggcctctgaaagtattctaactgacattccatctgcaatctcctgtttcaactggccgcagctccaggaccactcaggtaagcagatactagctcttgccttggcaaatatattatgaagtcttagcttggagagcctttgacttaaagtgaggtttacatttctaagatgttggtttcttgacttaactgtctatttgaattcctgatcttttccattcagagcctgtttacccgaactccccacttcagctacagtctgaattcctaacctcgtgtacattcttgatcagtgttatctggtggcctcaccaaccctgccagaatttcagagcccctctcaagtaattacaggggtaatcatgcattccttaactcttaggctgcattcttagggggcagattcctacctactaaccttgaacctgctgatgcccatgaggctggcatgaaagcaggaacaattagtctgttaaaaactaaacatatattcctgaagtctgaaaaaaggttctactcatccaaatagaaataattgagaactctaaaatatttaactttaaatggtctggaatcatcaatgttctttcaggttgaatgaatattttacattaaaaactttctgtcccttgtttacttggccaaataaggtaaaaaggtcaaaacaatcttagtgaaattgtttccttatgaatgacaaatgtaaagagtcaaaagaggaattaaggtaaataatttaattatatttcatctcccctaattacatgtttttcatttgcttagatattacttatttcacctctgctgccttccccaccatatacccgataactcagtcattccagacttataaactacctcaggttatatcagatcttcccagacctggttttcttcctagaaaaccattccatttttttctttacctcttggaaccctactcattgctcgagtctaagctcaaatgtcaccccttgtgcaaaatttattgctaactcttctgcacattaatatcatttctggggggctcacatctctagtggagcccttgtaatactgtatgtagttcatgtattaatcatctttgaagggagcctgtgtcatgtacatctttgtccctcctattgggtagagggtctcgagactaatgtagtcactgataaaatactgaactgaacttcatgcaaaagtgatttctgagaaaaggcattaaccaaatagtgccttaattttattacttgttttgcaggttttatgtacttaattgcaagtaggaggctaatgaaaaatgtttagtttttgcagtgtggtggtggtgaggggcatcccagcttgagtggtagaggtcccagcttaacacagaaatttagataaatgtggcaaattggtgggatgggcaatgtatctcatctgcactgagagaaaagctcaaggtgtaaccatttctggggctacatgtctagtcatctctaagagattggtggctccccagacatccattgcagggacactaaggaggtctcttaggagaaggcgtaatgaaagaacatattataaaccaggtgctttgctcagtagaaaagcctcggtcaacaagagaaagagaaagagtggttttgagaatactgtggtgtctgctacttagatttatcttctggttcagtcatatctgagtcccatgcatctaagtcagaattatttgcaagaccatgtgccagatgagatgctttctgctgcaggttgtagaaaactgatatgggttggatgtttgttcccttcaaatctcatgctgaaatgtaatccccagtgttggatgtggggcccggtgggggagactggatcatggggctggatccctcacgaatggctcagtgccattcttgcagtaataagtgagttctcactcagagtgagttcatgtgggatctgactgtttaaaagagtgtggcacctcccaccccctcactccatctctcaccatgtgacacgctggttctcctttcaccttccaccatgattgtaagcttgctgaagccctcaccagaagcagaggctgtcaccacacttcctgtacagcctgcagaaccatgagccaatgaaatctcttttccttataaattacccagcctcaggtattcctttatagtgatgcaaatggaattaacataaaaacccaacacaaaatgtcttgactagtcaaggcccacagaggcaaagctgctccaggactgggtaatccagaagcacaatgacattattccaggttcctcccatccttccattctgccattcttggtgaactgtccacatactcacaacgtagctactgaaattctgatctattcactcgttcattcaacaaatatttaccacgctaagatctattcttaggtaatttggatacattagctaacaaaacagacaatatccctggcctcatggagctcaccttctcatagtgaaagacaatttaaaaaagtatattaggccgggagtggtggctcatgcctgtaatcccagcacttgggaggccaaggcgggcagatcacgaggtcaggagttcgagaccagcctggccagcatggtgaaaccccgtctctactaaaaataaaaaaaaactagctgggcgtggtggtggatgcctgtagtcccagctactcgggaggctgaggcaggagaattacttgaacccagcaggcggaggttgcagtgagctgagatcatgccactgcactccagcctgggcgacagattgagactccatctcaaaaaaaaaaaaaaagtatattacacatgttaatcctgcagaatgagtgtatgataggaaaaaccagaaaaaacaggacagatgttccttttgctatatatcaccctagaacttactggctaaaaataaccatttatcagtattgctcatggttctgtgagttgactgtgctcaggtgggtgtttcttgcttgggttctttcatgtgtttgcagtcagatagtagccaaagctgaattgatctgaaggctccattggaatggctgttacagttttttcacttgtacatctggctcctcacttgggatggctgcggatcttcggccaacagctgggggctagccacgtatttgtctttccatgcagcttccccatgtggctagcttagatttgtggcttcttcatgtagacagcacagtggccttagagtagacttagtacagggcagatcactttccccagagtgagcattccagaagaccaagacagaagctacaagactccttcttatttagctttgaacttcttgcagaatcaattctacctccttcagtttgttgtacaggagcagcccagatttggtgtgttcctctacacaaggaacaattgcctggagacatgattcacagggaggagggagtgccttcctagaagagctatcataaaaaggtaagtgggaaatggattcagatggctgggaagagggagatggggcagttgctgtctaattagtgtggtcaaattttaagaaggttttttttttttttaagttgagatttgaataagacttgaaggaaatgacagagttagtcacaaagatttctggagaaagaatgttccaggtagaataaagaactacgcatagtgcccggagaaggatgcctgtttagttctctagacgagaaaaacctttctcagaaggtcccttagctgaatgccctttgtattttattacctaaaattgcgtaatatgaccatgtccaattccgaagagggcaatcaagactgcgagagcaccatgaaatagctcaggactatcattatgtattcccttgggttggggcttcccttgatgcacatgatatgcagaggagggtagatcctcaacaagcctggtggctgccagcaaaggagaagggtgtatatggacacatttggggaaaagaaaacaagagtatctttcttccccacaccctggggattaaacaatactccttttgggcctgtctaacaggacaactcatcccattttcccagccctagatcctgactatcagcagagaattcttgtgcttggtgtaagagcagaaaaggctggaaaggcagcgataatgaccaggatcagcatctaactcacccagtggcaaaggggccaccacccacagaaggtttaaaagtgtacactcaacagataagcagtaggtagcattcataatgggaaaatatgactctgaaagaaaatttttatgtggcactgagatactttgagatgcatgatcaatgaaggacctaattcaaagagggtaacattaaaattcccaagtacagcacagccacaaaagctgtagccacatgggcaactttactgcccctacagtttaagtgtctgatgggaatgccagacctaagaattggaattgggggtcctgacttgtttgaagcaagttaaggtcttttttttttttttttttttttttttttgagagggagtctcactctgtcaccagtctggagtgcagtggcatgatctcagctcactgcaagctccgcctcccaggttcatgccattctccagcctcagcctcccaagtagctgggactacaggcgcctgccaccatgcccggctaatgttttgtatttcagtagagacaggatttcaccatttggtcaggatggtcttgatctcctgatctcgtaattcacccgcctcggcctcccaaagtggtgggattacaggcgtgagccaccgcgcctggacaagtcaaggtctttttatatttcctcagtgtcacttacaataatccacctacacttgattttctctgttacaaaaagatagtatattaaaaggtagttcagtcgatatttatggatggaaacagaggtgaatatttagaaagactaaatcaaactgagataataaagaaatataagctataattcagaggaatggaatgccaaaagtaaggggagtggaatctgaagttcatgactatgctctcatatttttttcctgccagctgttggtagaaattattattatgatgatgatgattatgattattattattttgagacggagtttcgctcttgttgccccggctggagtgcaatggcgtgatcttggctcacagcaacctccgcctcctgggttcaagccattctcctgcctcagcctcccgagtagctgagattacaggcatgtgccaccacgcccagctaattttgtatttttagtagagatggggtttctccatgttggtcaggctggtctcgaactccggacctcaggtgatccacccgcctcggcctcccaaagtgctgggattacaggcgtgagccactgcgcctggccagaaattattatatgaaactagaagcctgttcaattttaacaaaaggatgcagatatgatgcaactgttgaacataagacaaattaaaatattttctttcttttcttttctttctctctctctctttctttcttttttagatggagtctccctctctacccaggctggagtgcagtggcatgatctcagctcactgcaacctccacctcccgggttcaagtgattctcctgcctcagcctcctgagtagttgggattacaggcatgcgtcaccatgcctggctaatttttgtatttttgattgagacggggttttaccatgttggtcaggctggtctcgaacgcctgacctcatgatctgctcacctcggcctcccagagtgctgggaccacaggtgtgagccaccgcacctggcccaaattaaaatattttcattgcaaatacaaaataccaagaggttctatatataatctttgaaagtaccctttctatttaaagatcaggattttttttcacatgtctagaaagaaatttggttcaattctattcactatgtatttattgggaacccattagatgtgtaatataatcaaatatcaatagattatagaaaagaagagagtcctttttcttacaacccagcagggcggaaaggattaaattcttcttataaagggagaacaaatagattagaaaagacgctgcgtagtcaagttcagaaaagtgagaaagtttagaaaggtttcatagagatgaactgcagttctaataataaaacttaacatttttataacatttgatagtttcggaagcagtttcacagaccttatctcattgcttcacatggaccttgtaagacaggtgggatttggataagtagttcctttaaaaaatgtcttcgaatattgtacatttagactgacaaatgcctttattagaataaagggaaaaggtatgtgagagacatagagagcaaattttgggttctagttccacaactaactagctgtgtgaactatgaactatcatgtggtgtctttgtaaactcaagggttggatttctggactttctgtgctgaagtgtaaaactaaaaatattaaaatattcagtaattcaaagtggatattttaaaagcaatgaaacatatcagtagattcaattgttttcttatttatttttatgatttgatattttatatttttagatttcaatttttattttagactcaaggggtacatgtgcaggtttattacatgggtatattgtgtgacactgaggtttggagtacagttgaacctgtcacccaggtagtgagtatagtactcgataggtagttttttcagcccttgtcccacaccctcctgcccttgtcactagtgcctgttgttcccaactttacatccatgtgtacccaaaggttagctcctgcttataagtgagcacatgcattatttggttttctgtttctgctttaattcgcttaggataatgacctccagttccaaccatgttgctacagaggacatgatttccttctttttcatagctgtgtagtattccatggtgcatatatgccacgttttctttatccaatccaccattgatgggcacctaggttgactttatgtctttgctattgtgaatagtgctgcaatgaacatatgagcgcacgtctttttggtagaaaaatttatatttctttgggtacataccaagtaatggaagtgctgggtcaaatggtagttcttttttttctttctttcttttttttttttttgagacagagtcttgctctgttgcccaggctggagtgcagtggcatgatctcggctcactgcaacctccgcctcctatgttcaagtggttctcctgcctcagccttccgagtaactgggattacaggtgtctgccaccatgcccggctaatttttttgtatttttagtagagatagggtttcaccatgttggccaggctggtctcgaactcctaacctcaggtgatccacccacctcgacctcccaaagtgctgggatcacaggcgtgagccacgacacccggtcatttttttcttggagttttggcaaaactatttaagtgttggttaaccttatgaagccacaaatttagatgtaagtactacgtcttcagaaattatagtttttttcccctaatttttctcctctggtataactttctgcttatttttatagttttcagtaacattttaacttagttttatgcattcatctattcaagacatttatagaatgcttactatatgaaagacactgccaaatgtcagtagatgtggtattcagggcctctgtccttatggagctcacattcagataggggaaacagactttcattaaacaagccaccaaacacatagctatagattttcgtaagtgctgtgaagaaagcaaacaggatgctctctgtgataatgatgggaaatcttccctagatgtgacttaattatacattaactctgcagtccattacttcaaatgatccctagttattcaatttacatactggaattttacaaccctgtttagttagtcccaggcttcaggccatttaaaacaaaagatatagatgaatagaagagtcactcagcttgtcttcatccttcagatctcggtcaaaggtcacttttattgggagggtgtcctgattgccctttcctgcctctcacccttactgcagcgcgcgcgcacacacacacacacacacacacacacacacacacacacacacacacacacacacatttaggtccttactatatattctggtagtgtcctgtattttctttcctgacacatttgtaattattttatgagatttaaaaaattactgtctgtcatcccaagaaaccataacctccatgagggcagagaaggtctgtctatgactgaatccctatcatctcaaacagagtttggtaaagagtagacaccagaaaaaaataattattgaatgaatgattgaacaaaggaggatttccgttcacttcagcaagactttgatgattcaaccctcttggtcctacagaagagtgattctagtttttagtctgtgaatgattcaggctctgagttaaacaggcaattcttgagatcgtggtctgaaattcatacaaccctcctactttaaatttcctcaactcatgatccaggtgattcctgacaaattaataaatgtgagaatgatgctgttctttttgtttaaagggtcgaatcataaatgaataggaaatgttgtcatgtcaattcaactttttatcagaggagtggtactgcatagttaggagttctgacagattccccaggcagactgtctgggttcaaatcctggctctctcacttacctgatatatgaccacaggcaagtcacttaacccttgggctcctcatttttctaacctgtaaaatgaggttaaaattgtacctccctcactgggttacgtgaggcttaaaagcattagcacatgcaaaagtgcttataattgtgaatggcatacagtaagtgctaggtaagttctcactattaatctcagtaagcgtaatgctcactaaaattattttcaaatttataccatatgactacattgattgtctgaataaagtaaaactatgtataaaggctgtacttctgatataagaatcatcttctaatttattatatttccaccctcccgtctcctttagtaaattaattaatatattaagggagaggacaacttatatcacagtgatcattatattaaggacattatagcatttataaaaataaagaagtattatgataaactgtatgaatttgaaattcactttgtggtatttacctttaaaagtagcatttctgaatttcatacgctagtttccattcccctttatggagttggctttaacacgcagcttctcatgtggcctgaaaggggattctttctactttctagaggaatgtgctgtgaaggaggagtcgggaatcttactggcggccatgtgagaacagcagctctttgaatgctgggtatgatgtagcatgggaactgtgagcagctactggcggagtgtttcacatgcagcgcagcggggcagtgggaaaggcaatgaagaaaacaaccagtgcaaacaaatgcagaagaaagggtggggcggggtcaaactccagggaaggagagaggtcagcccagagagacaagaacacttacaagaacaaagaataaagcagtgagaaattggagacaagggcaaatgtcagttgcagaataagggaaaaggacaagaaaacatgaccatcatggcaattttaaatgcctggaattatatacatgtttctagtaaggaactagaggtctcaggaaactaaaataaatacatgcatgcataaatacattttgctatttaaacacatttactaggaacacattccatttttaaaaacaataataaacacacttacatggattaccataatagctagccttagaactagcaaaaatagttcccgattaaaacaaattagaaattagtatataaagatcaagcaatcaagtagcctaattaatactttataatgatttgggttcactttataaaatatctgaaaataataatatgcttttcattctcttaaattcataaatatttctttggctcctgatggcttcattcccattttatacttcatataattttttcatcacattctgtacatcgttcatttatccccctgtagtttcacacatcctgatgccttcaaaaaaaaaaaatagagaattcccttgaaaaccagaccattcttctcctagggtgagaaagacagactctggaatatttgggccatattagtttcaaggctacctgagcaatttcgataacagtcctcttgactaaagtacaattagttgtacaaacattgaaaaccaaatgttcttaagcttgacagtacgctttgacctcagtatgctctaagggtggtcactaacctgggcatttaaatttatactctccttcttcaattctttaaagggttttgtttacatcctttttttcctaacagagttgaggttaagcataaatgattattctctccttactgaaaagatgttttcctggaacttaattgtccttttttcacgggtcattctattcctaatatcaacaaatccttctgtgacctaaccttttcaaaaacaaacacatacttctttcttttttttatttcctttacttttagcttttacaaaactctggccagtgggcacatcagactagatattatagttgaaatatttacataagagcaacctatagtttagaatatgttagagcagtttttcctacatcttactgcagtattttgggagaggtgctttctaatttgttttaaccctgtgtatttctcaataacattccaaaaactggagaattgccacataataaaagtactacttagtatctgctaattgagaaaaggctattagctgataaaaacttgtatgctttgtaacacaactgctttacttacaaaaaccagtggtatatgggcaacataattttgtattcaagctacagacaatgcttgatgcaaaaatatatttttgcacctctctgtaaaactctatcatctgtagtttgggaatgaatttctatatgtggttacaaatagacagcatctcctgggagcatgatagaaatgcagaattgcaggcctcacccgatactaaatttctgggggcggattggtttaacaagctttgcaggtgattcttatccatgctagattttgaaaacttttaggccaatgctatccaacagaaatataatgagtgctacatgtacaattttaaatgttctagtaggcacatgtaaaaattttgcagaaacactgcccattgttgtagccgaagcaacaggctcacttcattcattttcaagaaaaataaccaagtttgaataatcataataaatgagtgaaattcattatgacattttacccaagcaaatacataaaaatactatcatttcaacatgtaatcaatataaaaataatgagatattttacattctttttttggtactaagtctttgcatcctgatatatatatatatatataacatatacatattacatatatatcatatatataacatacatattacatctatatcatatatataacatatacatattacatgtgtatatattacgcttactacacatctcactttcgactggctacattgaagggctcaatggccatatgtagctatcatattggacagcacagttctagaccatgtgatttgaaatacagtaaatataaatccatatagcagcaaattgtgtttctggggatctattaacagtttcccttcatcctccacgtttccctttatcttcctctttctgcctcatagaaaagttaagtgcttggttctccatgatcctgcagcacttgaacactcctccaacacagagtttttgggatggcattatacttaatttccccagagtctaaacccttcacagtgtcttacagaagtcatatatatatttttttaacttttaaatttgtctgtacctgacaagtacttaacatagaacaggggttatcaaagtgtggtccatgattcagcagcattagcctcacttgaaagtttgttagagatgcagattctcaagctccacaccagacccactgaatcatttgaaacttggtatgtggagcccagttatctgtgttttaataagccttccaggtgaatttgatgcttgttaaaatttgagaaccactaatgtaggaaaacatatttatttggagaatggcctcatatttatcattttctcctgagttctgtggtagaaccacaagctgaatcattttagtcttcttaaagaaagaaaaagtcaagaaggacatgctagaaagacatcggtagatgtcttctccttatccccagttagtgataggccgacattatttgtaagagcagatggctaggctctctgtccagaagtgaccccataatgcaaaatgattagtacaggatcattaaaaaacaaaaaagaaagatatgaggaaaatgttcaaaatctgtcaacacatttaaaggatcaaatcctgtgctcaatgatggtaagaacaaacatacatagatacagataaaagacctgcttagaaaatcctatctcaccaaagtaaagaatataaatggttctgatataagaattgcttgttggaaaaaaactggttagtttttttaaaatgaagccacacaaatactcctattgtttagctaactatgatcccatcacatcctctcacaaagcttactactatgactatatagaccaagtttccagtaagaaattattgaataatttgtaaaccagagataataatgggtactgcttttgtagtatcagtgttatgatagtatgtaagtatgtatatttctggtttttaacactgagaaaggatgagaggggtgggccatcatggaagtaataaaagagaacccatctttaaagctttacttaatatagcataagcagtaaagggagttttgtttagtatgtccttggaccaaacaggatcattacaatgtcttctaggtacacagtagatgctcaatcagtgctgactgaatgaaagaacaaagggatgaaagaaggaatgaagtttgcaaaagatgaggctctagatccctgcgacagcaagttaccacagaggtatacagatggagtgtaatgatgtctacatgactttggaagaagcttaggaaacctttaaaaaacatacataatttatgatactgttctttgacatatgtaaagaatctaatagctggaaatgccttcatattattcagattttaaaggtgtttgcattccatgagttcctacagtcaataaaacaaatactccttatgttaaagtgtttttgcagcttttgtgctatttgtgggtttactcatgagtaaagaaaaatggtataatattcctttatatactacttgcgcttggtgaataaagagattgactgcattactcagtgtgtgtactatttcaaaattagaaaggtttatcatcattttaacttttttctcacctggtttagatattcgtttctacttggtcaaatattagcattagtttggctttaagagctgattcactgaaatcacttttggctgattttagtacaattgctgagttctaaaggcaatgaggaatataatgctttaaaattttatatttgaaacaagtgtgatttctaaggggtacactgaactgggttcattaatccattggtttataaaaggaagatttaaaagttaatatacctaagaatcatttcaaaaaagaagatacatgtaaaaaagtgaagtattttacacctgtattgtccaaaatagttttaaagtattgctttttttttttttttttggaaatggtgtcttgctctgttgcccaggctggagtgcagtggcatgatctcagcttactgcaacatccgcctcccgggttcaagcgattctcctgcctcagcttcccaagtagctgatctacaagcgtgcgccaccacacccagctaatttttgtatttttagtagtgatggggtttcactatgtgttggccaggccggtcttgaactcctgatctcaagtgatccacccgcctcaccctcccaaagtactgggattacaggcgtgagccaccacacccagccattattgctttgttaagtccaaacgtaataggattttgagaagaggagacaaaaagagcatgggaatagcagttcgaaaaacctgactcagatcttgactgatacaagttatgtgactgtgactgtggtacttcatgtttctaagcctcggtttccttacacgtaaaagggaataatgataataggtaatcataatcataatacaaaatcacaaggttgtgattcttagatgagagaatgcacatgaggactttttctaactgcaaggagtgatggtttcctacaccacaaaaagtcaaatggtcaaatagtaacatgcataccaatgtgtctactttgaggaagaaaataggacttcattcccacagaaaatttcaaacaggcaaaccaatgtctcttacatttctattagaagattcaaagtcagtttggaattctctatacattatgattctatacataggtaaattgtgactgggtttgactgtattgttggtgctcacatcccttaactggtttcaccattttgactgatattacagacagctaaaaaactagcatggctttccttgaaaattaaatgaatggataatgcaaagaacccaggatattctgatatcaagtagacacggcctgatagtatgtaactctaatctttctattatactattttgcccaaatttaagactcttcttcttttctcaggtttacatctgcctttctactactccagttctctatttttattttattttattttatttttgagaccgagtctggctctgtcgcccaggctggagtgcagtggcacgatctcagctcactgcaacctctgcctcctggtttcaagcaattctcctgcctcagcctccagagtagctaggattacaggcacgcaccaccacacccaggtaagttttgtatttttagtagagatgaggtttcaccatgctggtcaggctggtgtcaaactcctgacctcaagtgatccgcctgcctcggcctcccaaagtgctgggattacaggcgtgagccaccatgcccagagagttctttactttttgattgttctttgtcttagtggacagaggcaaagatgaacttgtacttggtttttatcacgatttaaagattgacatagcattgtgactaaattctttattttcatagaaatatgtcttttttgacatttactatttaaaaaaatatgatgtcataatggtggtgggctcaagcttcccgccatagaacttggataatgcgttagcctcacatacattgttctaaatataaaatattctcaacaggatgtatgaattgcttttccagtaatgggaaaaaaattgcttgatgtgaacctcatttcttgctttcttctctttctgaacaaggcctcacatttataatgtagcagaattactatcaaagaaaagaatggaactaacttgactcggttatatgcaaaccaaaaccttggatttatcagctttctgctaaaaacactttttaagcatatctttaaggtcatgttcaaaaatagaaacatgaaatttgctacaatatagagcagacaccacaaactgaactgtttaataggagaaggctgtgtatatgtgggtttagggaagaagagattaaaagttagagttatacaaggagaaatataatttcaacaaaccacatttgtattatgaataaagaaaggaacttcattggttttaaactaaattctgtcaaatgtgtatctcccccagatatctagagacagaatcataagattgaactgtatgtgaccttagacaaaatagatttctgcattttaaaaatgaggagaattaaagctgagagaggttaaatggctttctcacaataacacggtcaaataatggctgagcttaagtttgaagttagacctcctaatagtcaatccaatgctcttttcgctatatcatactatctccttacatgtgttttcctgtacttataaccaagtttttactcattgtaaagaatggctacatagtaagctatttactgtttttgataccttaaatgcaaataaatagtgcaactagaatggatcacttagcattgattaaaaaaaaaaaaacttttcttactagtcataatcctttgacctcatttggaaatctacctgccactgtcacaaatcttttaccacgttctgaaagcaaacgtggcattctgctctctaaaagaaattataaaatatacttctagaacacttatatgggactaatgtggccattggttttctttggacatttattactttccttatttatacttaagatgaaaaacatactaaggatggaacagataaaattttaatagtactcaactactatggagcaaacagagaaaggcatataatcacttagctatatcgccttgctttagtcgatgccacttataacaatctagaatacaaatctttcaggactatccatcacaacaagaattaaattatgtgagatctcaagaggtctgggatttgcaacttatctttattaaagatctagcaattctttaacaggcctctcaatcacacccctaaatggactgacaataggaaagtgatttggtttattatatttttcttattaaaaagttaaaaccaaatagttttaaacccagtttcctcagaggcataccttctgcatcctgttggaaaggagaaaattggaaaggagagaaaatgattctctaattctacggttaaactaattttagggttttggggtataacatggtgtccttcacactgagaaggtagacgcacctcttccaccactacaaccattactctgcatgaattaactcattcgatgttacagtaaccatgttagagatgagtaaatggacaaccacagagattaagtggcctcaaggtcactcagctaatatgttggattccaaaacctgtgtactgtaataataataataataacaacatcaagagctagaatttgtagagtgtttatcatttggcatgttcgctcccgagcactttccatttattttgacttattcatcctaataataaactgatattgcagagaattttattatcgcatttttttttttttgatgaaagactgaggctcagaaaggttaagtaatttgctccaggtcccatggctagtaagtgtgaccttgagcagcacacttacattgcctgtatttattacgcaaacctacgaaaaacttccacatgtaagtttgtgataggatgctctttctttaaatgacttttggacacatcttactattgactcttgtttaaattaggattctaaagggaaagatgtttttgagaatccaagcagtaagagtacaaaggaactgcatggtggcaattcacatcttccatcatgattcagcattattttctgtttatcgtaagaatactgctacacagagtttggatgttccctctaactcgcgtgttgaaatctgatcccccgtgttggtggtgaggcctagtggaaggtgtctgggttgtaggagtgaatccctcatgaatggtttggtgccattctcacggtagtgagcgaggttttgctctagcagttttcatgagaactggcacctcccctccctctttttctcctcctctcttgccgtgtgatctttgtacaccagctcccctttgccttctgccatgagtggaagcagcctgacgccctcgccagaagcagatgcttcttgtacagcctgcagaactgagccaaataaacacctgttctttatgaattacccagccccaagtattcttttatagcaacactaaacagactaagacatatactaagtcttagttgcttccaaaattaatattaataatttgaaaatgtttagatgggaattataaactaatataaaatatcctatcctcacaaatattaccatgaacattacatgaaaaaagtactttcattgttctttacaaattttatctgtatattattttactgtaacaaaggacaacaatgtttacaatgtgcttacctgcagaagcttccatctggtgttcaggtcttccagagtgctgaggttatacggtgagagctgaatgcccaaagtggtaagctggcgagcaaggtcattgacgtggctcacgttctctttcagaggcgcaatttctcctcgaagtgcctgtgtgcaatagtcaaaagcaaattggaagatgagaatatttaaaacaagaagaactgatacctgggcttattctctttagggtgcagtgccagtaatgtttgctctatgctacggtttgaatgtttgtgtcccccctcaaattcctatgttgaaatcctaaaaaataaaaaggaaacgaaatcaaaacacctaaggcaatggtattaggagatggggcctttagggaggtgatttttgggattagcgcccttataaaagagacctcagagagctagctagctcctttcagcatgtgagggtgcagtgagaaggtgctttgtatgaggaatgggccttccccagacaccaaatctgctggtattttgatcttggacttctcaacctccagaacagtgagaaataagtttttgttgtttcacaagctatccaatttatggcatttctattatagcagctggaacagactaagacagtctcttgtggtagtattataacaatggatatttgttaatgggggaataatgataactactatttgttgagcacttcctaggtgcctaatgccatgatgagctctattcatacataaactgattttatttctacccaacaatcctatgaggccagtagttggagaattctaattttatacatgagaaaacaaacttgcagaggtttgttttcaaaacaaacaaaccttgccaagctctcatgggtaaaaattgaggaacctgggatacctatatgcaggtttgcctgcctctagaatatatattcttaactattatgttatatgcttcccctaagaaattctggattggcaaagtaacaagaaaaatatattgctgctggattctaaattctactcatgtcacaaccagaaatggatccttattttttacaatagaaagatatattcagtcataaaatattgcatgcatactttgcaccaaccacatcataacagtttcatttagggagtagggtattttgtcaagtcctcagaatgacttcctgatctcctggtattttagcccttgtagcaatgacttcagaaggctcccgtggggcttctcagctgtctttgaagcactagagcaggagtctctgatgcaatacatcatagcaatccgttgagcagaagaaccctatgcagatatggggaggatattaccacgcctcatatctaccctatcgagatggcatttatggatctttaacatgatgcatgatgtccaaatgttccaataagcaatttctaagggacaaattccctcacttaggagaacagtttgtgtaatgtaatgtctgtgtacaaggacagcaccacttgactatacgtgttgttttgacttgcttgatctgggcaggtgttatttctctgtctggttcactatgttgataaaaccattggttacactgacctcatttataagccttgcatttcctcccactccaaataaaaggagccagtatgaacattcaaaataagaacgacattatcctctcaaatcaacctgaatacttcatcagtaaaccgtggtgctgtatagagcataacactgttgtgtagttcttagataatacaaaacattgtgataatcactctgttgaacttaaagttttaaaaagtggtcattaaaaacattacgttaagcaatcagggggtttcttttggacgataacgaaaatgttctggtattaaacaatggtgatggtggcacaatcttgtgaatatactaaacaccactgaattgtacactttgaaagagtgaattttaaagtatgtgaattatatattaataaaaacaaacaaaagagagccccttctgaccatacacatgcaaaaaaaaaatcatatgtgatgtattcatctgtattcaacttcgtgttagtggaatgtcactggaatcagtgtgaaattcagaaagttttataggggtggatagtaaatattgttccatttccttatgaataaatacatggattaaaagtatcagaataagggcccatggagaaaggtggtttaaatccatatatatgaatacttatctctaaaaggaaatgatccatattaattttgttttgcataatagaaaggttagaaaacagatttcttaaatgtcaatgggggaaacttggacaaggacaacggttacaaaatgaaatcattctcttctggataataacgtgcatttctagtagccacaaataaatatcatgtgaggggaaactgtaaacaggaacctctgcagagagggcaagccagcaggcagcatctttcagtgatacaggtgagtcctttgtgctaatcatctctctttacaagcaagactctcaagccattaagttgattatcctacctcgttaagccatagctagatttcagttccctttaggtgacacaatgtacattttcaaatgtctcttattagaatattttgattttcattttctctcccaaattcctgagcacacatattaatcctgcttcaatgttttggaggatgaaggggattcaaaaataagttttggtactcataattaattgcaatgctctcccttttcctctttttttttctttttaaaatttacttttcttctttaaactttaccataagatcttgggattttttttttttttttttttttttttgcttctttcaagcaatgatagtggaagttctctgaactaatctccacttaagactcaccaaattagccaaagtcttcattctctttgtgaaacagcagtgatgggaacctctcacagcctcaataaaatgttcgaggtgcctgtcagtatgtgtggaccttctgctcccatcagttgacttgttacaaccgtcagttgtgtgtatgttctcaaacctatctttgccagtaactgttgtgattatgtaatttaataaagaaagatttcctaaatcataaaaatattagtttaaaaagaaaagaaaaaagttattatttctataaaaaccaggccaaatactctggagagttgcttcaaaaagaaaaagaaaataaatattgttgaagtagttgtgaacaagacaactgctaaagatgaagaaaacaacccagaccaggtggggtggctcaagactgtaatcccagcactttgggaggctgaggtgggtggatgggtggatcacttgaggtcagcagttcgagaccagactggccaacatggtgaaaccctgtctctactaaagatacaaaaattattcgggcgtggtggcacatgcctgtagtaccagctactcagggggctgaggcatgagaagcgcttgaacctgggaggtggaggttgcagtgagccaagatggcaccactgcactcactccagcctgggtgacccagcaagactctgtctccaaaaaaaaaaaaaaaaaaaaaagaaaaaatgccaaatattcagtttaatctgaattcctaaatttctgttaaaatatttgacaatggaagctttgactggtgtgaggtcagttgataaacagataactgggggcaaaggttcactttggggaagtctctagatggggttgagcagactaaaggacttcagtcagctagaaatcatcatgagggcactcaacgcatgaaggtggaagaaaggagataacagatggtaggaaagataaaaaggaaaaggaggcaggagaatgctcatgtcagtcttcactttggcatttgatttaggttttggtagcagcttttaccacccaaggatggctcaccactgtgggctctcagtgcccagcagcatacataacaagaagtatggccgcctaaacacagagtcacaagaccttcaccctgtaaagggtgaacacaggtactttgctatttaaatagatgtgacattggtttggctatatttcacagattagagcttttaatatgacacacataaatttgtgtttaaattattaaacactacacctaaaatgtcaaaaagcacagttaacgctgagcaatacgaggtgctatttaagtgatatcaggattgcattaggttttttttctagtttggaagcagtaagtgagaaaacattgaagaaagccattatattgtgggttttctttgaatcacttaaacatctggaatatgttctccatgaaagagcaaaccaagtctaattttattatgactagtttctcacaggcagaattttcagttcattaaatgttgtctgattatagatacaaaagtactgatttagaatgataggtaagtctgatataataagtttttcttcatataaaattaaattgcctgtcatatctttgcttatctttatgtagctaaggatttgttcaaatacacatttaaaattatagtcatctactacttttctaagaaaataaaggaattgtctattaacaagggaatcttatttttgagggaggaattttgacttgacagttaagagaacattcctactgcaaagcacagaaggtcagttggaaagactagaaagagtaaattgagggaattctgcttggaggggttttatttcctctgtgaagtaggaatcaacagacctggcatagtctgcagtgcctggcatagcgtgcagtgcctggtgtgcaatgaatagtcactgaatgaaaacatgaattaagggtaagtgggaacatttgaattaatcgtaatagagactgtgagagggagttgacctaagagatgtaatgaggttggcaaacagtgttgagggcccacttgaggatgaggttcaacattttttagcagaaccaatctgcctgactttctcattttctccaacagtgttgcatgtaagcatggggaaaacagttgatccaggtttggggtttcgtcagatgactgtggctcacacatttagggataagggagtttcgatattagccaggatgtaattgaaaaaatatactgtggaatctaaactggattaggaggaaagcaaagcaaaatgaagcttgtagatggagagaaagtagaggggtcagttgtagaagtccaggataatccataaaaggccacagcaggagtagctgcacaaacaagcgacagagaggggagactctgggatgctcagattagctctactggatttgccacttatgagtttatttataaatggtgtgatatatatatatatatatatatatatatatatatagatagatagatagatagaaatctggctatatatatataaatatatatagtgctactcagtgtttgaaaaacttcccttcttagggatattaaatattcctcctaaaatcttaacctgctaactcatagacgtcctatctcacttactaggaattcaaaattactaggttccaaaaatgaagtgttattcttgggctacatacacgtgcagagaaatttatgttacaaatattacttaagtagggactaatggcattgctgtctaccatgaatccttgtcaaacaaatgtttgttaaccaagactcttggaaaacagcctaaaaagaggaggtgctaggaaagaaaagtcccagcattcttcatgctgagctagtcatgagaaggcaaggatgagcaattagaaatcatgtcctataaatactggtgtttagtacttattccggggctcttcctcgtggttcagggaagccctcacagaatgcaattacccgggaattggcagcaggtacagcccagctatgttttgcagctcctgcatttctcagcagatatatcatcctcatggggccaagagagtcaaggactgtatcttgctttttccagaggatcagaggcctactggaatctctcaaatacctgggcggaatgagctactcaaatgctgttgaaacaattaaaaagaaacacaagttgagctgtaagcaagcccttcatgaaatgtatcaggctcagagacttccatcattatctgtaatttttgacttttcattctggttggttccctgactgctctgatgcccagaatgtaggtacagcttttctttcagatacctactgccttcagccaggtttaagagaagcagagtctgagtgctcttaagaaaaagggagtgagagaagcaggaagacagggcaagaaagttaagttgggatgtggtatgggctggagaccagcatcaatctggccccatgggaattcccagatcacaaattgtacaacagcaggtgccatgatgaggcaaaggggttttccctttgtacccctggtggttttaagagagaaggtgtggtgggacatgccagtcaaggtggcttccttttggctgagggaggttctctggaaaggggtgaaaccatgaggctttagcagctaatactcagagtcactgaggaatgggtgcaccaacccagtgaacgaatctgactggggcaccaacagcatccattacttagattaacttcatctgctttcccaatagcctttacccttgaacttcagttgtcaagcacttatattttgtttttttttttttttcaggagacttttcttttcttttcttccttccttccttcttttctttctttcctttttttatacaggagacttctttctttctttctttcttcctttctttttttcaagagacttctttctcttttttctttccttccttccttccttcctttccttcctttctttcctttttttttttttttttccaaggtggagtttcactcttgctgcccaggctggagtacaatggcacgatctcggctcactgcaacttctacctcctgggttcaagtgattctcctgcctcagcctcctgagtagctgggattacaggtgcccgccaccacgcctggctaattttgtatttttagaagagatggggtttcaccatgttggccaggctggtcttgaactcttgacctcaggtgatccacccacgtaggcctcccaaagtgctgggattacaggcctgagccaccgtgccgggcctgcaggagacttcttaagtgaattttcattactaacactatggggctatttcatagctctccaacaaaactgggattgtcaccctttctcgaaagttgagtccctcatttctgccaaattctgagggactgtgtggagctaagacaaaggggatactttgcagactgagcgaatacaaccctctgcctttagtatcacttatgcttctggtagagacattctcgacaataaattatgccattgaaacgtactttaaaaaaaaaaaagggatgtgattgcatttttttccagcaacagtttttattgtgatagcctgaaggcaaaatattatgcagtttcttttcgttgtctccttccgttcagttttcagggcaattcttgtaaactttcatatttgggcatgatcacttttgacgagtaaactgaataacaatataaataatgaaacagactcagaactaatggcctagatttagcataatcagaaacacttaagaaaggttaaagtcaaaaaaaagatcttgggaaaacaatattaagtttgtaggcatgaagaaatttagggcttttatttcccaagcgattatcagtaattatattttaactatggtttcttctcagactcaacacgcttccaaatttgtgacattaaaaaaatagcaattaactgctctgtgttttccataaagaatccacatctttttataaaaaacaatctcaaccaggtgcggtggctcacgcctgtaatcctagcactttgggaggctgaggtgggtggatcacctgaggtcaggagttacagacgagcctggccaacacagtgaaaccctgtctctactaaaaacagaaaaattagccgggcatggtggtgcacacctgtaatcccagccactctggaggctgaggcaggagaattgcttgaacccgggaggtggaggttgcagtgagctgagattgcaacattgcactccagcctgggcaacaagagcaaaactctgtctcaaaaacaagaacaaaaaactctagtttctctttacaatatcgaaaaagaatatatacccaaacataaaaggataactttttctttttaacattttctctttgcactgatcataattcttcatcttttaggacatggctttctatgaagcttgtaactccaatgttcttataataaaagccgaattatatcttggccatattaacagtgtctatcttctttcttttctgggtgctcacatttccttcatgtataaaatttggaaatgaggaacagggaagtattgaccacaaaggaaaagtttttatttttaagaacaagttgaacatagcaggagcaattgatattttgcaaaccatacacccggtaaggggtcagtattcaaaatacacaaggaactcctacaactcaatagcaagaaaacaaatcacctgactaaaaaatgagcaagtaacctgaatagacatttctccaaagaagatatagaaatgagtattcagatttatagacaggaaatagaatggtggtttccaggggctgggggcaggaagcaatggggaattactgtggttttttcttttttgttccttttgagatggagtctcgctctgttgcccaggctggagtgcagtggtgtgatctcgatctcagctcactgcaacctccgcctcccaggttcaagcaattctgctgcctcagcctcccaagtagctgggattacaggtgtgcaccaccacgcccagctaatttttgtatttttagtagagatggggttttaccatgttggccaggctggtctcgaactcctggcctcaggtgatccgcctgccttggcctcccaaagtgttgagattacaggtgtgagccaccatgcctggtggggattatcgttgaatagacatagagtttcagttttgcaagatgagaagagttctggagatggatggtggtgatggcagcagaacaacgtaaatgtatgtaatgccatggaagtatacatttaaatagagccaagatagtaaacttcatgtaatttgtattttaccactatttaaaaaatcaaaaataagtacaatttgtaaaagaagaaacttgaacaaattttattaatttccttgggaaaatgtttctataatcctaactgcaactgccagttatctcccctttatagacaaaaaacaagcaaaaaaaaaaaaaaaaaaaaaaaaaccacaaaatacttcaagctttccaatgacacaattaaaacaaataaaaagatagttcatgagtgtttcacagaggctaaatacaaaatatacacaattaacacaaaaaggcttttaatgagcacaaataagtcatttaagcaggtcatgctttaggttgctaaggaaacagaaaaaataccaatattttctgtctgaaaaattttaattatatgtgacaaaatgaagcaaaatggcagttaatgaaacctattaacttccttaaaagtaagtaataatccataaaccattaaaatatcaaccatgaggatgtttatcttcaaattcagaagttacttcagacagatgaagttttactttttttttgagatagagttttgctcttgtcgccccggctggagtgcaatggtgcgatctgggctcactgcaacctccgcctcgtgggttcaagcgattctcctgcttcaacctcccaagtagctgggattacaggcgcacaccaccaccatgcctggctaatttttctatttttactagagactgggtttcaccttgttggccaggctggtcttgaactcctgacatcagatgatccacccgcctcggcctcccaaagtgctgggattacaggcgtgagccactgcgcctgaagttttacatttaacaagtttttgggcttgcaatcatttcttggtctgagccacatgtgttaaccaccattgtccctgaatgggccctctccctcccctaaatagctcaaaacatcagtctaaggcagtgattctcacacaatagtgtgcatctcattgtcatgtggaaggcttgttaacacagagactgctgagtcccacttagtgcttttgattcagtgggtgtaaggtgggcctgagaatttggcatttctaataagaagttagaaaatgttgagttcctagaactcatcaagctttttatttctttatttatttttattttatttttcagacagggcctctttctgtcgcccaggctggagtgcagcagtgcgatcatagctcactgcagcctcaaactcctgggctcaagcgatcctcctgcttcagcctcccaagttagccaggactacaagcacacaccactggcattgatatatatatatttttaagttagttttttctttttcttttttttttttttttttgcgagatgggatctctctatgttttccaggctggtctcaaactcctgggctcaagtgatcctcccacttcggcctcccaaagtgttgggattacaagcatgagccaccgtgcctggcccaagcttactcttgacttagaaccttcagatacactgttccctctgcttggagttttatatatccactttatgcctagctggctcttattcatatacttctgatctcagttagatgtgacttttaaagatagcctattcccagttggttgccctacgtaaagtgtctcctttttccttgactctcaacaccctattttccttctgaaccctgatcacaatttgcaagtacatatatatttgcctattcatttattcattgtctgttccttcccaagaccagaaaatttattaaggcaatcctacattattgtttttcaccagtatatgccaagccatagtacatgataatccctcaatacatttttattaaagaacaagcagtcaagagaattaggcacttctgtactaattactaatacttcagaccaatagctattgtcagactgcttcgtaaacagtttctcacagaaacctgacatagagttcctaaataagagaaagctacccattttccttatcccatatctgaattatttatatctatcacttgatttatattggagcatttgctaatttctgaagcatctctcattctttgggcaagaatataacatttcagtttttggtctctaccagggatttttaaaataaaaatggagtgagtgggaaaaaaagaggaagtagcctattcaaggaaaatatattctgcttggtggtggtggcacaagttagtgcatcttttggagggcattttaacaacactgaataaaagcattaaaaatatttacatatgaaaagactagaagactacaaaccaactgaaatccagcctgggctctactaccaaattggttaggcttggcataggaccggggatctcttcaaaaacacagtgcctttttcttctttgcccaaagaggcccttgcagggattgggattatagatgctggggctgagattacagatgatccctctctctctctctctctctctccctgcctccctaatttttgggcttttccactaaagaaaagttacttaaataatgatatgaactaagaagtcatcaaatattagactgtaacgaagttcatttacaaatattttccacttgtgtagaaaagggatagtaacatgcatactttagggctgttacaaagatggatgagaagtttaggcatatttctccttcttttagttcacatatagtcacacaagttcctattcaggctagtccagggagactctgcaaagcagtaggtaataagttcatccatgagagagtcacagactaagatcctttgccgggtagctacctttttggagctgatttctcacatcgccccaggggcaacctctatcatgtagccttataaacgtctcctcgaactagacattggaaagtaggtacatgaaactgataaagaggaagcatagtgtggggaagaaagatatgtgttcagaacttgaacaaagggtaagaggtaggaaagtttaatgtgtgtctgaggaaaagcaaatagcctttaataacttaaaatatgaagtacagggcagctgtaaaagatgaatcatgggtgttttctgggatcaagattgtggtgggtcttgaatgaggtggcctttacaatgtagaatgaagatgtccacaaaacgggaatggcattttctcggcaactcttagatttaattactactcacttgaaaacacttactttatatccactagatactgtgcccacatatatgtgtgtgtgtgtgtgtgtgtgtgtgtgtgtgtgtgtgtgtatatatatatatattatatacctatcatccactggaaaaatggaagtctcaacacactcacaatcattagcagaggtacacaatttaatgggtcattaaaaaaaatgcaatccatattatgagaagttgagtcataggggtttggaaggtgcagagaaagatgctgatggaggggaagagagacctcctgagtagataaggtgactgaaatcattcacagaggggaacactagaagaggcatgttcctctggacatgaaatagtcacctggaaaatctcaagtagatcagtataacttgtggtcattgtggaaaggagaagagacacagagtgtttgtatgcagagacaagaagtaacaatggccagaaataagctggtggcaaatggagcaaattatttgcaaaataatttttaagggtcacgctatctaaaagatagcattttgccctatgcttttgcacaaatttgtttattcatttattccaaaaactattattgggtacctattatatgccagggaatgttctaggcactggaaatacagcgtaagatagaccaagtctctgtaatcatgcagcttaaggctaatggatatcatttcatttaaatgatgactattaataactaggcttataaagaagcaaattccaagccaaaatatatcatggctataaaatacaatttttgaccaagaaaatgcaggacaaagtataatattgcagatagcagtctcaaagagattctgttttcacttattaaagcaaattaagctacctctgcatgtctgaataatgattaatagaggaatctagaattgtgagttacccgtgcaatatgctgtacctggtttgctttatatggagcacatttatttagttttggttctagggggaaggcactcactactgaaacaaaatggatttttactgatttgatttttcattcaatatattattaacttagaaatactaaggcagaaatgaaccaaagattaatacaaatttttaagagcagtgataaaaataatacacagaagagggctaaaaaggattgcaaaaacgtcctttaatatccaattttactttcagattattgtagttcctaaatgtaattaatgtttttagcctttctaaaatggtcttatttcttgcaaacaaaataaaaaagcaggatgttcaactacttaaagtcaaacgaaaggaacagaaaacgaattttcttcattaaaatctatgcaacatcataatggttcatcttcttttcatcatattctgaggctgaaaagaaagtcttatgtattcatttctgagcaatgtgggccctctggacacattattagttgttatttttacttctgtgaatacatgaggttgtgaaaagtctagcttcttgagtcaagagtttattcagtttgtcatttttctcaccataaaattgatattttcaagatattattctgatttttatgatcacatcttaaggtaatatctaaattcatatcctgtaatagtctgttatgacaactgctatcatgataatgtccagttaagtacatgcaaatgatgaataaattactacttacacaaatgagtctaagtgtcaagctgtctaaacaacgttctcagatgtgatttccaaaaaaaaaaaaaaaaaaaaatcactcattggccaaatctaccctttagaaaaagtgattgatattcaactaacagatatatttaatagtaatagacttttttctttttcaaaataggagtatgatttagtgccctcaaaaatctgtgggggtgatgctgcattgattatctaaaggagaatacaatttcagtaggaaaaagagttcaaaactctttttaaaataatcttttcactaataattcagtaattttagattcaaagtgggtcagatttcaccaagacccctcttgcatacaacaatcaaccccaaaccctaggcagttttataggagaaacgactttgcaaatgtcttccttcaacctttatacaaaaaaaaaattgagatggttccaaaggtaatattttattcacagcataagccaacggagtaatttatgctcatttgtttagcctgtatttcttttaaccttatgctttattggatgcacaaaagtcaccctgatattggataacctttgtggagattctagtatattgggtttgtgaaagtctaaaacaatggaccattctctcccttgctttagccccatccctgctagaaacatgtgaagaccaaaaaccaactggcaagcagaaggtgaagcaggtaaaatgccgttgcatacagtctgcttgcttgggggcagataagaaacttaaatcacaggtcagttaaatgggtattatttaataagacctaataggctttaggttcacaacaatggatagatctcaaaatgggttacaatgttttaagagtaggaaaaaagtaaatgaaaggaaactcagcagtagtttatcattggttctaaaaaaaacacatcaatgtattgccaaagactctcattcacttttgtttctacttaattcctgtacttcggcatatattgccaataaattgacttcactctgttcactaacttgcttatgccgtgttaagatcatgatgatagaatgtgaatatttgatagggaaaagttctaaatgagtcatttgagtctataatgatgcataatcccggaaaaccaaacttctaaaaataagtgtgtttcgaaacaggactggcaggttcttaactttatgaagaaaaaaaattaccataaaaatcaattccttaaaagaaaatagaaatctgtcttagtgttagatcctccagcctcattctggttaagagaatttggcgtttcagggctgagcacactgtggaaacttaataaatattgaggtttacaaacaaaaagcataacaatgatatgtggaccaattttcaacaacactgaaaatcaatgtgcccttactctgcctaattcagttaactcaattatttaatgtacacttgatttgagtgggtttgaccatagctatttccattttccattgaacattaatcaaattgcttctaatgtaaaatttcattttttctcatccttctcctctcccagattctaggataagggaaaagtttaagtttcatgtctcttgtttaaagttaaaagcaaattttaagacatctgtttccattagtttatcccataattctcttttcatataccactcaccctataccacaaccatgaactttttcacagatatttaatacattgttttttgcaccattttgggaaaaatcctccttcctcaaccacttcagctaagactcttttctactttctcccagttgatcccacatcatctctatttcatctctatttcacctcatctctatttctatacacaaaaatataccctccccctgaacacagagcctcaaggggtggacaaagtaagttataaaatgtaggcactcctggagaagctgttagctattcatatctagcaagtagattttacttaaaaagtgttgactgatcccaactatttttaatatcctagattcagaaactctataaagtactattttatcatcagtatgtttggtagaaaagtgtaaggagaatttttaaatgtaattgtttttattggtaaatgcaaaaaatatttacacaaagtgaaaagttatgtgactaaatatatatatagtttgagacaaggtcttgctttgtcactcagcctggagtacagtggagtgaacagggcacactgcagcctcaacctcctgtgctcaaacagtcctcctgccccagcctttcgggtagctgggactacagacacatgccaccacacctggttaatttttgtattttttgtccaaacgaggtttcactatgttgtccaggctggtcttaaactcctgagctcatgcaacccacccacctcggcctcccaaagtgctgggattacaggcgtgagccaccacggccggccatgactaaatatttttaacgttaaaaattaatactgggaaggcaagttatgctgttggtcatctgaagcaaccccaaaattgtaccagtgtcattaaaataccaacaggaaaaaatgaaataaaccaccgtcaaagtcttccacaagtgagatttagaaaagaagccatttattcatttcaaggttcctaagcgaaacaatgctccctatgatgctcccatatctaaactattaatcaatccaacaagaggctgtgtgcctgcattcatttttaaactaaatcttctggatattgataaatataaaagaaataataaatgatatatttattacttgtaattgaagaaacgctaacactacacaaaatatgtcttcaggtacatacacagtagctttactatggaatattggttctcagaatgtatctctgaaccagcagcatcatgaacacctgggaacaagttgggacttcttagccttgccccagacattttgaatcaggaactctggggaaggggttcaccaacctgagtttctacaagccctccaggtgattctgatgtatgctgaggtgagaaccattgccactgaaaattcttgacattctcaatgatgtctggacatgtctgaatgcctagacatttacagattccataactataaagccaaactcacttatgaggccattttcttactaatagtgatcactttcttagactttttcattcattaactcttctcttccatcactaattctgatgaacagctatcaagctattcatggtagggtggagggtaggtggattttccataaagaaacaaaattctcattatttataaagaattactgtacatgcaaaaacaaaacagcattaaaaaaagccaagttgaatatgaagagtgagtggattactaggtttacttattagttgcaggggacactttacctaacctgggcatccatccttcagctgctgtgatggttgactattaatgtcttatagctacctgccttctccacatgtgacctctgcttatgggagccccctagcccaggaagtaacccatatcccaggagtggaccacagccagtggtgtgctgcagcagagcccaagagccaattgtgtgcatctcctcccaattccatactcagtggcattatgtcggtagctggagatcagtggtagagggagtatttacaccacgaaaactggttttgatacacaccaggattcatcccacctcagagctagtcgacaaatatttgccagcacttcagtgacacagacaatgactggtataaaggcacaactccggctcggtgttgtggcttacgcctgtaatcccagcactttgggaggctgaggtgggcagatcacctgaggtcaggagttcaagaccagcctgactaacatggtgaaaccccatctctactaaaaacacaaaaattagccaggcgtggcggtgcatgcctgtaatcccagctactcaggaggctgaggcaggagaatcacttgaacctgggaggcggaggttgcagtgagctgagattgcactccagcctgggcaacaagagcgaaactccatctcaaaaaaataaaataaaataaagagtacaactccacagcgaggtttctgctcgagggcttgctctctctctggatcagacacaatgtgaggtttcacctgaaatggcatacttgctgggctctttcttctcctgtattgtttccctaactccaatacaggcttctcctgagagcagaccctctataaatcacaggcacctagacccctgttctcagggtctgcgttcatggaacctgacttaaaatgccatttaactcattagttaagtgactatgcacaaaagcttgaaataatacatgttcaaaattaagagctgctagtcatggaactttggatcacaataatcagatgaacctgcaaaagataaatttgaaatagcaagggtctgctctttttgtctgtgtacataaaagacagaagttgatggaaaaagataaagcctgcaaaaactgggcaatcctttatactgtgattctcaacttacgctttcatgtccataggtgaatgtgctgaaagattccttacttcagaatttgaagaaaaagcatcttcatattaaaacatgatgaatccattatggaaaataccataaaattgatgtgagatttaaaaaataaaacaagaacatcaaagaaatttcatgctcatggaaaaaggagataggtaagtggaagcgggagatgtcaggctatgtcttctatgctgttaagataactgaagtaaataagtttaagaatcactgctctcggaagatgcttttaaatagaaaaacctgcagtaagtgtaaactataactaaaaatattattttaacatgaaaaaatcttattatgaaaaagttctttcttaggccccattaaaatgagagagacattagtatcacagacacaactgttcccataatacccagaaaactgatttaccaagaaaaattattcaatgccattacttaacttagttaatttcaggttgtgtaaggcataatactggtgtcaatgctaactgttaaattttgaaaattgtaattgtcaagcatgacaggaagaagcgaactccttgggttatttgatcttaaagcatttcctgttttactgaacggtaggagagtaacagaattgtgaactttattcttgtcacaactttggtagatgtcaaaaaataattaaaaatatatattggctgtgtgattccattttcttaggaaatatggaatttcagttaaataaataactcacattttagcactgtttctagttaatgtggtacatgcacatgtatacacaagctaatacaaattcttgctccctcagcttggtgctaaataataatattcccaggaaaactaagatgccatctatacaactctcaatataatttttgtttttgaaataaattaaatgttcacactctataatgagatcagacttctctgggtataggtttcaatcatatcatgaattaatgaatgagtgcatttgtatatcctctaatactgagagtatattacttaagttttttgaataatcttttattacccgagactcttgaggaatagtatttctagttattacccaccacaaacaaagctttcagaaaatcctagcaaacaggattggcatattataggatcagatgttgatatggttgttttcaaatagtaggaaggatggtattatttggagaaatttttattatctgattaaacacttcttgagtagaatcagatgaactcattagctgaacattttgattacccgtgttctcctaaatatcccatgaccagaagagtagctgtacaactctgatttaatccaataacaataataaccaattctagctccttcttttatcacagtccatcaaaataacacaaagaagtccaaattaaaataagttcaatgacaaaaagaacatgttccttttccaactgttctaaagccttttcctgtctttaagcaaagttcattcagtcattatctcatctatgaaagtaaaagcagaaggatgtttcccttattaaataaatggctttatgctttcgatgtggaaggcatttcataacagtcaaaaaaggaagcgttttgaatgccatcaactcatttcctcccacccactgttttaaatcgtttgtttggttccaatgtatactacacttacataagttgtttatgaagagccaaattaatagtctttgcaattgtttttgttggaatttggagagctgacaagtgaattagtagaaaatggcaattctacatgaattagcttttaagtctccctaagaggctgatgcagaacttaataagagacttattaggagaagtaggacaacttaattcagattgattatagacttcggtgaagacagctggggttcaaatgaaactgaaaaagaacttatatgcacttcaaagtatgctaagcagatgtctgaaacaattactccgctctgccttttcagaagtttcaaaggcgggatgggaatagcatggtaaacgaaggttctgtttgcctaagtcgaggtaggggcttttaaaacacacacagcgctatctaaaatcagatgctttggggaaagaaagtgatttgacattgctgtcctaagtaatttgcttttagctttataaacaaagcaggagatgagagggaatacatggtaactaagtaataagctctcctggcaacactaacttacaattaatttcacattgaataaataatttggtcaggattttttttttattattattatactttaagttctgggatacatgtgcagaacgtgcaggtttgttacataggtatacacatgccatggtggtttgctgcacccatcaacctgtcatctacattaggtatttctcttactgctatccctcccctaacctcccacccctcgacaggccccggtgtgtgatgttcccgtccctgtgtccatgggctctcgttgttcaactcccacttacgagtgagaacatgcggtgcctggttttctgttcctgtgttagtttgctgagattgatggcttccagcttcatccatgtccctgccaaggacatgaactcatcctttcttatggctgcatagtattccatggtgtatctgtgccacgttttctttatccagtctatcattgatgagcatttgggttggttccaagtctttgctattgtgaacagtgctgcaacaaacatacatgtgcatgtgtctttatagtagaatgatttataatcctttgggtatataaccagtaatgggattgctggatcaaatggtacttctggttctagatccttgaggaattgccacactgtcttccacaatggttgaactaatttacactcccaccaacagtgtaaaagcacacctatttctccacatcttccccagcacctgatgtttcctgactttttaatgatcgccattgtaactggtgtgttttgatttgcatttctctaatcaccagtgatgatgagctttttttcatgtttgttggccgcataaatgtcttactttgagaagtgtctgttcatatcctttgcccaatttttgattaggttttttcttgtaaatttgtttaagttccttgtagattctggatatcagccctttgtcagatgaatagatggcaaacattttctcccattctgtaggttgcttgttcactctgatgatagtttcttttgctgtgcagaagctctttagtttaattagattccatttgtcaattttggcttttgttgccattgcttttggtgttttagtcgtgaagtctttgcccatgcctatatcctgaatggtattgcctaggttttcttctagggtttttatggttttaggttttatgtttaagtcttgagttaatttttgtataaggtgtaaggaaggggtccagtttcagttttctgtagatggctagccggtttacccagcaccatttactgaatagggaatcctttctccattgcttgtttttgtcaggtttgtcaaagatcagatggttgtagatgtgtggcattatttctgaggcctctgttccattggtctatatatctgttttggtaccaataccatactgttttggttactgaagccttgtagtatagtttgaagtcaggtagcatgatgcctccagctttgttctttttgcttaggattgacttggctatgtgggctcttttttggttccatatgaaatttaaagtagtttttctaattatgtgaagaaagtcaatggtagcttgatggagactgcattgaatctataaattactttggacagtatggccattttcacgatattgattcttcctatccatgagcatggaatgttcttccatttgtttgtggtgtcctctctcatttccttgagcagtggtttgtagttctccttgaagaggtctttcacatcccttctaagttgtattcctaggtattttattctctttgaagcaattgtgaatgggaattcactcatgatttggcactctctttgtctattattggcgtataggaatgcttactatttttccacattgattttgtatcctgagactttgctgaagttgcttatcagcttaagaagattttgggttgagacgatggggttttctaaatatacaatcatgtcagctgcaaacagagacaatctgacttcctctcttcctatttgaataccctttatttctttcccttgcctgattgtcctggccaaaacttccaatattatgttgaatacgagtggtgggagagggcatccttgtcttgtgccggtttttaaagggagtgcttccagcttttgcccattcagtatgataatggctgtgggtttgtcataagtagctcttattattttgagatacgttccatcagtacctaatttattgagagtttttagcatgaaggggtgttgaattttattgaaggccttttccgcttctattgagataatcatgtggtttttgtcattggttctgtttaagtgatggattatgtttattgatttctgtatgttgaaccagcctggcatcccagggatgaagccaacttgatcatgctggataagctttttcatgtgctgctggattcggtttgccagtattttattgaggattttcgcattgatgttcatcagggatattggcctgaaattttctttgtctgttgtgtctctgccaggttttggtatcaggatgatgctggcctcataaaaagagttagggaggagtccctcttttcctattgtttagaatagtttcagaaggaatggtaccagctcctctttgtacctctggtagaattcagctgtgaatccatctgttcctgggctttttttggttggtaggctattaattactgcctcaatttcagaactcgttattggtctattcagggattcgatttcttcctggtttagtcttgggagggtgtatgtgtccagaaattaatcaatttcttctagattttctagtttatttgcgtagaggtgtttatagtattctctgatggtagtttgtatttctgtgggatgagagctaatatcccctttatcattttttcttgtgtctgtctgattcttctctcttttcttctttattagtctggctagcagtctatctattttgttaatcttttcaaaaaaccagcccctggcttcattgattttttgaaggatttctcatgtctctatctccttcagttctgctctgatcgtagttatttcttctcttctgctagctttggaatttgtttgctcttgcttctctacttcttttaattgtgatgttaaggtgtcaattttagatatttcctgctttctcctgtggggattttaatgctgtaaatttccctctaaatactgctttagctgtgtcccagagattctggtccgttgtgtatttattctcattggtttgaaagaacttattcatttctgccttaatttccttatttatccagcagtcattcaggagcaggttgctcagtttccatgtagttgtgtggttttgagtgagtttcttaatcctgagttctaatttgattgtactgtggtctgagagactcttatgatttctgtttttttgcatttgctgaggagtgttttacttccaattatgtggtcaattttataataagtgtgatgtggtgctgagaataatgtatattctgttgatttggggtggggagttctgtagatgtctattaagtccacttggtccagagctgagtttaagtcctgaatatccttgttaattttctgtttcgttgatccgtctaatattgacagtggggtgttaaaatctcccactattattgtatgggcatctatgtctctttgtaggtctctaagaacttactttatgaatccgggtgctcctatattgggtgcatatatatttaggatagttagctcttcttgttgcattgatcactttaccattatgtaataccattttttttgtcctttttgatctttattggtttaaagtctgttttgtctgagactaggattgcaacccctgctttttttttctttccatttgctgcttggtaaatattcatcgatccctttattttgagcctatgtgtgtctctgcacatgaggtgggtcttctgaatacagcacactgatgggtcttgagtctttatccaatttgccagtctgtgtcttttaattggggcatttagcctgtttacatttaaggttaatattgttatgtgtgaatttgatcctgtcattatgatgctagctggttactttgcccgttagttgatgcagtttcttcatagtgtgatggtctttacaatttgttatgtttttaccatggctggtaccagtttttcctttccatatttagtgcttccttcattagaagctcttgtaaggcaggcctggtggtgacaaaatctctcagcatttgcttgtctgtaaaggattttatttctactttgcttatgaagcttagtttggctggatatgaaattctgggttgaaaattcttttctttaagaatgttgaatattggcccccactctcttctggcttgtagggtttctgccaaatgatccgctgttagtctgatgggctttcctttggggtagcctgacctttctctctggctgcccttaacattttttccttcatttcaaccttggtgaatccgattattatgtgtcttgggttgctcttctcaaggagtatctttgtggtgttctccatatttcctgaatttgaatgttggcctgtcttgctaggttggggaagttctcctggataataacctgaagagtgttttccaacttggttccattctccccatcactttcaggtacaccaatcaaatgtaggtttggtcttttcacatcgtcccatatttcttgaaggctttgtttgttccttttcattcttttttcagtaatcttctcttcatgctttatttcattaagttgatcttcagtctctgatatcctttcttttgcttggtcgatttggctattgatacttgtgtatgcttcacaaagttctcgtgctgtgtttctcagctccttcaggtcatttatgttcctctctaaactggttattctagttagcaattcctctaaccttttttttaaggttcttagcttccttgcattgggttagaacacgctcctttagctcgtaagagtttgttattacccaccttctgaagcctacttccgtcaattcgtcaaactcattctccatccagttttgttcccttgctggagaggagttgtgatcatttggaggagaagaggcgttccggtttttggaattttcaggctttttgtgctggtttttcctcatcttcgtggatttatctacctttggtctttgatgttggtgaccttcagatggggtttttgtgtggacgtcctttttgttgatgttgatgctagcagtcaggaaccctctgctgcaggtctgctggaatttgctggaggtccactccagaccctgtttgcctgagtatcaccagcagaagctgcagaacagcaaagattgctgtctgttccttcctctggaagcttcatcccagaggggcacctgccagatgccagccagagctctcctgtatgagggtgtctgtcaacccctgctgggaggtgtctcccagtcaggaggcacgggggtcaggaccccacttgagaaggcagtctgtcccttagcagagctcgagtgctgtgctgggagatctgctgctctcttcagagccagcaggcaggaacgtttaagtctgctgatgctgcacccacagctgccccttccccgtggtgctctgtcccagggagatgggagttttatctataagcccctgactggggctgctgcctttctttcagagatgccctgcccagagagaaggaatctagagaggcaatctggctacagtggctttgccgagctgcggtgagctccgcccagttagaacttcttgacggctttgtttacactgtgaggggaaaactgcctactcaagcttcagtaatggcaggtgcccctccccacactaagcttgagtatcccaggtccacttcagactgctgtgctggcagcgagaatttcaagccagtggatcttagctggctgggctccgttgggggtgggatccactgagctagaccacttggctccctgacttcagtcccctttccaggggagtgaatggttctatctcgctggtgttccaggtgacgctgggatatgaaaaaaacgcctgcagctagctcggtgtctgcccaaacagctgcccaattttgtgcttgaaacccagggccctggtggcgtaggcacccgagggaatctcctggtctgcatgttgcggaggctgtgggaaaagcatagtgtctgggctggaatgctccgttcctcagggcacagtccctcacggcttctgttggctaggggagggaattccctgaccccttgtgcttccggggtgaggcgacatcccaccgtgcttctgcgccctctgtgggctgcacccactgtctaaccagtcccagtgagatgagccgggtactgcagttggaaatgcagaaatcacccaccttctgtgttgatctcactaggggctgcgcacctgagctgttcctattcagccatcttgccagccacttctttggtcaggattttaaagatgaataattcctgctttagtttctaagctgtattaaaccctagatattctattgaaaagctactgaaagtaaatcaatatatatgaattcacataatccataatcttacaatagcataaaatccttaatacagtactggtttagaaacccagtaacatctcttatcaccagtacataaacattctattaaaaatataccgtacttataaagtatggagtgacactcgctataatatggcctttgatagacatattttcagatattaaaggccaaatcatatgcttttaaacattgcaattgcatgctttgtaaactagataaaaccctggttactccaaataacaggaattagcttcatatttaacccagatttatgaaggattaaatattttttctttgttttttcttctccatcaaaggcttacttaatacacatagcatttttacaacaacaacaatgaaagcctccacacggcaattcatttgtagttctttaacaatgcacaaaacattaataaattttcctcttcctactataggcagtataccttattcattatgaagatatcacaagtttattcagagttgggagagcttacatgttttgaatgatttttaggatcgccctgttcatgttggttctatctgctcattcatcccctaattctataagaaaagataagttttccttacataactcatatataagaaatcaagtaaggttgacttgactcatataaatgggaagcataacaaaattaatacaataagaagaaaactttagaaccaaggttaagaagagaaaagcaataagggaagatagttgcatgaacatggttgcaagtatcttgcttgccaaagtgaagatgaaattctaatacattatatcacatttcacattatctattcagaggaaatatgcttggcttcctcaatgtcaaattctaacatagcgtttctttgacaaatttctcaaaaaaacccaaagccacagggactgaggatggtaagcctaaaaaggtggatttgccagttttcttcttaaaactttagatgtgaatgctgaagataaataaggatggcatcgtcacttcatcataatttctagcctactacacacatcattaaatcaatctcaatttgaatgccaaaaaaggtttaatcaaaacatttcattgtaggaactttaaagaaaaaactcatagaatccctgccctgacttttcacagtaagaaatgcaagttaaaagtttgacaaaaatgcgatatgcataactacatagatgcgacagatttgcatattccaagatggcagcctgggagagttatttacagtgtatgaaaaactgtgttcagagtcaacaggtaaactaagaacagtgaaatattcctggctcaagaaggacataccacttttggtacagagaaactatggtttatagtctgggcgcagtggctcacgcctgtaatcccagcactttgggaggccaaggtgaacggatcacctgaggtcagaagttcgagaccagcctggccaacgtggtgaaaccccatctctactaaaaaatccaaaaaaaaaaaaaaaattagccaggcgtggtggcacatgtctgtaatcccagctactcaggaggctgaggcagagaattgcttgaacccaggaggcggaggttgcagtgagccgagacagcaccactgcactccagcctgggtgacagagtgagactgtctcaaaaaaaaaaaaattaaaaaaagagaaaccatggtttattaaaacaaaaacaaaacattaaaaaacagcaatctggccgggagcggtggctcacgcctgtaatcccagcactttgggaggccaaggtgggcggatcacgagatcaagagatcaagaccatcctggccaacatggtgaaaccccgtctctactaaaattacaaaaatcagctgggcgtggtggtgcgcgcctgtagtcccagctactcaggaggctgaggcaggagaattgcttgaacccaggaggttcagcgagccgagatctcaccactgcactccagcctggtgacagagtgagactctgtctcaaaaaaaaaaaaaaaaagaaaacaacaatccacaaaccttttcaccttgggattgtcctgaagaacaaaaatcttgtatccagactacaggtttaaaagttattctactttattaaagcctttatatattccacttacagatctatgtggaacacctagtaattcaaaaagttattcctattccccattacaaggaaggtagaatatttgtctagtcaaataagcactggtgctattttcagtaaagtgaaaagtcatgatcttgcccttaaaatatttgataagcagtataaatcatgaattttaaaagtaaagaagcatttaaaacttaaatttgattctactgttttttcctatggaagctatgtttggaaggctgagattctcttagtgagcaatatagtcaatattaatattgtgtttccatttattaatttaccatgttcaccacccgcagatgatcagctagcaataatgccatttccataaaggccagggacttagtcattgttgtttcacccattctttaaatccaaaagccacatttgctaatacaattacagaatgctaaatctcacagaaacacatattacttagtttcttgaataacaagttatttaacacataagatcagaatggagggggggtactatgatagagtgtctaggggtaaggaaaatgaactgatatggatatataaaatgttcttctagctagctgcctagttatcagtgctgtaatccactttgggaggccaaggtgagtggatcacctgaggtcagaagttcgagactagcctggccaacatggtgaaaccccatctctactaaaaaatacaaaaaaaaaaaaatagctgggcatggtggtgggcgcctgtagtcccagctatttgggaggctgaggcggagaactgcttgagcccaggaggtggaggttgcagtgagccgagatagcaccactgcactccagcctgggtgacagagcgagactgtcgcaaaaaaaaaataaaataaaataaaataaaataaaataaaataaaataaaaaaagagaaaccatggtttattagaaaagttccctacagcatgaatcctctgagggcttaaattgctgagtggaaaaatgggaagagtggtttcaagtacacttctactttttttctgaaataaattttagttaataaaactcattctttgtaaactactacccccaaagcttcagagtttcaaacccagtgtcaataagatgcagtggagaaaaatgatttatttccactgcaaaattaaagaagagctaccgaagggagataaatatatatgaattcatgtaattcatagtttgaaacacgcataaaatacaacacagattcaaaagcccaatcacatctactattaccagtacataaaaattcagataagtaccataacttaagtgtatatatgtctgagaaagatagatgtgctgggttataaatataatttttcgaaaggtatgtttaatgtttatatgttttgctatcattgggatcagaatgagagttttaccaatcagggtatggaaaatgaagtttgtcttaagaccaagaacagataagacagggaaactaaaaggaataccgcaaatagggttgggtgaaggccagctgatacttgaactgttatgcttttagttatttttaattattaaattatgctgtacacattctcttctccatccatactcagtatcttacaaatgcacctgtgtgacaagtatggctaaaaatgaatcccttatgtctgctctacagcctatctattgagcaatttaattgacatattaactaatttagttccactgggacattttcctaacttatttctcatttttggagaagtctgtcaaaaaattagtccctatatttttgaataaaatcaacatatttaatgcttttaaaatactaggtaatacatttcaaaacccttagttttccagtacacagcaaggttaacccttactttaaatgttagacatggggtcataaaacattggggtagaagggattttacaagtattagagtcaaatttttaatcttttctttttaaaaattttacctactattttaatgaagagctatgcaattcaacattagaccataggcttcatgaaggcaatgatcaagtctgtttcttttataactacctgtccagcacattatataatgactcataaacagttgttgagtgaataaatgaaggtacctaatgagattcctcatatgttgctggccctgggctagcagcccaaagatgtacagcatgatccttgctcttagcaacttcactttctctgggagaaaaaaaaatgcataagcaagttgctacaatatatgtgaaatttaagtgtgacaatttagcatgcttggtgatctatgagagtaccaactgtaagcagtttcttctgcttggtgggagttgggggttgtagacactcaggaaagacaacaaagataggtaacattttggctggtccttgagggctgaaggagaattcgccaagtagacaacgtagggggatccagacagagagaacagcatttgcaaaggcagatatatctatatctatatctatgtgtatatatatgtgtatatctatgtatatatgtatatatactatgtatatatctaactatgtatgtgtgtgtgtgtatatatatatatatatatatatacacacacacacacacatactttacagacacacacattcaatacactctgcccatatcacccctttttcccaaatatgccatcacatatatatatatatcatatgggcagagtgtattaaatggtctggagaataggagctatggctgagaaggtaagtcaaggctaggaagaaaagggccacgtaatctccttattcattggatttcattctctaggcaagtattctcccgcaaggagtttggattggaattggaagaagctgggtaatgcaggaacatcagcaaagaaaccattcatccatccattaattcaccaaatgtttaaaatgcagtatctgagatatgccaggcacacagaggggtgaatgggatttaaagatgtatactgttatcatctaagtaaaagatgctggggattaaaaaggacattggttaaaagaggagagaaaacacaaaagagctattctgaggtaacatgagccatcatgtgccatcagtgaaaatgcagaagggtttaaggatgaacctaaagtttctagcctggaaaatttgttggatgatgattcattaactgaaataggaaacaggaaaaaaaaggtcagataagaggggacagaagtagggaaatggaaaacaggagaacaaatgaacttggtttcagaatagttgcatttgtgatcgtaatgccacatggattcagagatcagaagagagatgcggactagagatgtagatacatcaccatccaggccatctcaaacagggagggtttaaacaatcaaaagagaattaggctaaggttagaaacttgggcacaacagtatttgaggggtggctaggagaagaatctagaaaaatataggaagaagaacatggatggaacagttccatgaaagccaaggaagaggacaacttctagaatgaggatgctgagatgctggcaaacatgctgagtgcatgagggaatttaacttcttttgaattttaatctaggaggatttttgtgattttgacaatagatgagtagttgctgatttcaaaatgatactcctaaatatgtatttttttctacagaatatatttgccatctttgtgccacaagggaatttaactttggtcttatagacagtggtcttccaaatatataatgattttccctcatttctgcagtgggccaatgaaacttgaaactgtattacaaatgttgccttccaagggaagggcaacacattaacagccttatttcaccaaaccataacttacccaagtcatgtaatttggttagcaaaagggccaacacctagactcctggcttttgattaagtgttttatttttctgtattctgatactaagtaacacaagcaatacaccaatacacacacacacacacacacacacacacacacacatcagactttagtacaatcacttaatatcaaagtcaaagtgatttcttgccctgtaactgttttaatatttcatttcatataactgaagacagacaaataattagatcactgtcttctcttggagaaaataccatgtgaatgaagactgaatttgtgaaagacggactgatttctctagctttaactttgtgggaagataacactgcactcaagttcagattagaagctcttttgagtctctcaaagggccctgaagcaaagaagtagacggtaccttgactttctcgaggtgatcttggagagagtcaatgaggagatcgcccacgggctgccaggatcccttgatcacctcagcttggcgcagcttgaggtccagctcatccgtggcctcttgaagttcccggagtctttcaagggtctcatctatttttctctgccagtcagcggagtgcaggttcaatttttcccactcagtattgacctcctcagcctgctttcgtagaagccgagtgacattctgggctctctcctcaggaggcagctctaaattggcaatatgacaaggttttaggccacattctttttttttaaacattgtcaaaaaggtcatactggaagaaagaaagagtacagttgaacaagagggtaacctactgattaacggcttttttatactttggcataaattttgatacagcccagaacatctaaagtatatcttcctgagtttctaccttatatcaatccgacaatttaagattcacttaagctattgaggagaaaaacgttaggatgcataccacaagctctaatttacttcaggcaggctcttaaatggaaaattaacttgtagtctttgcaacaatagaattcctcctcacagataactccctttgtttattattttctaaatgttccaataactgattgctaatctcttttgatgtttatttatgaatgcacaaactgatttatgcatggtagtttatgagtccttatttttttttcagcatctatgtttaatttgaattgattctatttaaccaagaaaatatgagagctatccagaccctggcagcaagaatggatgggctgctccgtcaccactgatccttctatcaatatgttattatagttccacattcaattacctctgggctcctggtagagtttctctagtccttccaaaggctgctctgtcagaaatattcgtacagtctcaagagtactcatgattacaggttctttagttttcaattccctcttgaaggcctgtgaaatgagatgaaaagaagtgcttatttggcttgtggcattcttctcaaaattaatcctgggtgctcagaacttgtttatgaaactcccaggtcaatttctatctcttttatttatacactgatggttataaaatgattttttttaaaggctatatgggtctatctgttaatgaggaaagcgctgtgtttgtaaagctattctggggagatggggggagcattctggatagttaatgccctctcattgagataagagtgctttgtttatgtaacctgacagccatacttcaaatctacagctaaagtttcaaggtatatattgcaaaactctagcatggctaatgaggacttaaacataccccaaatagtggatatccagaacataatgggaagccttaagggccatttgcaggaccttaggctatattaaagtatacaatgaatccaactgacaatcaccagttaattctgtcaaaatgtctgacaaggtataaaataggtaagctaagagaaaagtctcaatacttttgaaaaatagtcattacatcatccattgtgacctctttgagaatagtagaaatgttttgagctattatggatgtaggaattgcggacactagtttctataaatgaacagatctagaattaatctttaatctgtaatcttcctttatccaggggatcaagagaaaaacaaaatgaatagtttctgccttcaaaaagtttctagatccaaagaagggagaaaattaacactagaagcagagtgaaaacagtaagttcacacataatcgagtgctaaaaggatcgtgaggtataccgtgagcctagaataacctaacggatactctgacaccattgaagagagttattgacccagattctttgatctcagaagtgagggtattaataaaagtattaagtgcatgctacataaatgctaatataactgtttaacaataacagtaatatttgccctgatctagggcttaatttttgtaacttttttcaactctgtcttttagcaatgttgcctgctgaatttaagccctgttctttcactggggaaaaacaaattagcagtattcttccttgaatttcagatatgccattatgttacagaagtgttccagagctgtattgtatgacacatttattaataaaatcttagcggtgttcaccattcaaaagaatcctgagtctgatactttgcaaaatgattcatcatccacagctatttacaattcaatagagaaagggaaggcgtttgaaccaaaatactggagttctgtaagtagaatattaggattcagcctacagatagggaagtactttctgaataatgggatatttctgtaccctaaaatcatgctagatacgtgagttatttactctgcttacatataaagctgattctcctgatatttcacttgaaatctccatgtttgtgtgtgtgtgtgtgtgtgtgtgtgtgtgtgtgtgtgtgtgttcagttgttgtattcttgtgttttttttcatacaattaagtttcccaaattcaagtaaattatcattttgcctagtttctctgtttggacctgaagggaggcaattaatactgacattactaattataaaaataataatggctccctctattgaactaccatgtgtcagtggttgtacctgaaactggaaatacaaagttgaatgcaaaacagccctttctatttaggaatatttaacatataatagaagagtcagacacgtaaataatttcaatacaatgtagacagtgctatagacttgcgcaatatggggaagaaaatcgggaaaagcttccaggagaagctagtaatcacatagaattcaaaagcatgaacatgacttattcaaggaagagtatgctagagaacattccaagaagaggaaaatgcaagtgcagagtcataggacatagtgcagtatggtatgtatcggaatctcaagcaggccagtgtttctagagcataaagaacaaggagagggcatgtccaaagatgaaaaagacactattgctatctggaaatacattagatttttaaaccagaatttgaagctctgcctctctatgatcacatatggtccactaagaggcttaggtgttgccttgaaggtaatcaggaacctttgaacggttttaaccaagggagtggcacaggaatatgtgtgcttcaaatagatcttcctgatataaatacagagtatgtatttgagaagaacagaaatggaatcagagagataatgaggcaattgtaagaattcagtgcaagattatgaggatttgactcagggcaatggtaccaggaaaaatgacagggataggatagggaaatgtctaaaaatctgaagtgtgaaaatttggtgactgaatagatgctggagagaagagagaaaaagaaacaagaatgacacttagtgtctaggttgagtagatgagcaaacgctgggtgcaattcaactaagtatgaggaaataaactttcctggatgtctcagttcacctacagaaagctctagcctcctgagaaacttcccacaccatggagattagatctgtagcaatttgtctagttcatttctctgatccaagagggtcaaacggttatagctcagggtaggttcctaagctgaactctatgttgttagaaagactggagtgggtatctttctaggtatttacatttcaaaaaatatgaagcccataccttggagacatttccagattgtaaaacatgagacacacagggctagctggtttctgcagaagctggaattaggactcaggcctgttatgtttccacagagaacctttcagaatgagagatggatagcagcctccttctcctttataagcagaaaaaatgatttttcctagtctcccacttatggagtacccagccactcaagtaggaaaatgtttcatcagcgttcatcatgttgccctaggggtaagtctttgggcaaaggaagggcacagcaacaatatttactgtaaggtaattaaatgaaatctgcctctgattcagaacccctcatgctcattcaggataaaattattgaagagtaatattaaaaatgcaacatgatggtgtgtgtgtgtgtgtgtggggggggtgttctgtgcatgggggacagagtaagggactgtgatatgctcagcttggaaagctaacattccttccacaaggaaataataaattctgaggtttgaggagaaaaaaaatacttaggagttattttctcattcagctaatatacgttgagtgcctacatatcaaagtttaatgggcaaacagaggaacaggatctcttgagagatagaaaaggaacaaataggtggagagattaggggaaatgaggagtgtagaaatttcaaggagagagtgagaattttgagaggaagagggtgaccaagtgagtccaatgaaacacagaagtaaagtaagatcagcattgcagagtgttcactagatgtgctgagagcaatttcagtggagggcagaagcctcagaagtaggcatagctgaggagtgagtggaagaaggagtaggtatttcaagtgaaaatcaaatgttcaattttctttttctgagaaggaaaagaggaagacacgacaggaggacagagaggataacaagacaaagggataagaagttctttttagcataggaatgatttgaacctagagtgaaagacggaagctagcagtagggtaaccaaccatcttggtttgtccagcattgagtttttcaggatgagagactttcgatgttaaaaccagaatagtttcaggaaaattggacagtctcaggaaaacgaggaaagttggtcaccctagatatatgttacgaccttgacagaaggtggagataattgttggaacaaggtctgtaaaataaggaaatggatcttttttttttttttttttttttttgagatggagtctcgctctgtcgcccaggctggagtgcagtggcgcaatctcggctcactgcaagctccacctcccaggttcatgccattctcctgcctcagcctcccgagtagctgggactacaggcgcccgccaccacgcccagctaattttttgtatttttagtagagacggggtttcaccgtgttagccaggatggtctccatctcccaacctcgtgatctgcccgccttggcctcccaaagtgctgggattacaggcgtgagccaccacgcccggccggaaatggatcttaaaggtctcatcaaacttaaaaacttaaggcactaaaaacttaaaaagtccaaggcactatttgatgatataattccattgttaaaactggacagtaaataattcaaagctaaggagcatccattgtgagagaccacgtgtttgcccatcgagttgttgccaaggacttagatccaccacagctgcacagttcatttcttaaatatgagtcattgaagattaaaatgaggccaaagaaaagacaaagaaagttctgttattacaaagacataagcaccattattttcacattgttgcctgaaattaagaaaagaaagtggatggaagagagggttaagtgattgtatctttagaatttcaaaagattcagattaaatacaaaaggataaaactcccacaaaaagagagaaatagttggttcaaggaggtcagaggttaaagaaaatggcaataattcttatcatgtgggaaaaactataaataacaatatgtaattttaaacatggttatatgtaagatcctctttaatttagtcacttaacaaacttcaagcaactactatgtatcagacactgttctaggcaatgaacatctgtggtctttgtagcatggagcttaaaacaaatggctttatgtagtaaaaaaaaagcaatgtagaatctgcattaaaataatggaaagccaatttttcagtatctaataactcaccataaactgcatgttgtagtataatttattgcattttaaaagaaagaaaaatgaagacttttttttaaaaaaagacaaacaagaatatttaatgtcaagagccttgattttgataagtgtcttgtctcccaaaaaggcctgtttgaaagaggtttgagaaaatatatactcatatatactgattttgtcatataaattttggttaatattttaaaccagagaagtcagttcctttatgtgatgatagaaaaggtatcagatatagatattttctcccatgtacatacagaatacgtatttacaatattcagatgttagcattcagatgttaagataattacttcctgaatcccttgaacagataaaattatctttgttaaaacacatcctcttccccatacctttcttttcacctttccaagacagccagacccaagggtccaaaatagtgatatgagagaattagaagcaatactaaagacgtagagcacctctatgaaaataaaatatgcaatttagaaaatgttaggaatactacacagatgtttgtccttgagcttcttaaggttcacaaaataaacttatatgaagtatgctactacactattatagcaatgataatctcaagataaatctatttattatgaaggttgaattatctggtagattgcacttaaaacaccataggtactggccaaccgggtgactgattgttgactcactaatttgttcattcaaaaaatatttattttgaacctattaggtacaaagttaggaaagatatagagacttaatctttgtcattaaggagccaatagtttggttgagtaggtatatttgtggtgtatacttttatattatgaatgtttcatccatgcaaattgagatacagataagttagggtttacctaaggccatcagttaattacacactttgaatctaaatcttgcaattctaaagtgaagctgaaagtgagtgataacaaaacataaaatctccctgacttagaataatttggaagccacataagtggaaaatcctaatggccatggaagaaatcagaaacttaaaaaattcctgaaagtaatagagaagaaccaagttattgattattattatttttatttatttatttatttatttttgagacggagtctcgctctgtcacccagtctggagtgcagtggcacgatctcggcttactgcaacctctgcctcctgggttcaagtgattctcctgcctcagcctcctgagtagatgggactacaggcacgcgccaccacaccctgctaattttttgtatttttagtagagacggggtttcactatgttgggcaagctggtctcaaactcctgacctcaggtgatccgtttgcctcggcctcgcaaagtgctgggattacaagtgtgagccaccacacctggccactgattatttttttctgtccctcttgcttcctgcttatattataaaaatatctaaataatgccataaatagaagtagctcagaaccacgtatggaggggatgaaaggtgagatattgatttgcttcatgagaggaacaagaggagaactctgggcataggtaatgacatgacagggagaaaagctatcttgctttctcctggggacagtggatttaggatcatattactatggatgtgagtaaaagcccgtgcttttcaaaacacagatgtctttcaatcatgtacagcttgcctggcgctgaattttacctgtattcatattgaaatggtaaatttgtgtttttcagaataaaatctgatggaatgactagaaatactacccatatttgtaagcagaacttcctagaatcatcctgggaggcaggctgaagtggtgaaaagagcactgttctgagtggcagaagccttgggcttcaagcctgggctgggccagaacctggctgcagtgatccagaaaaggtgataaactcttcctgctcctctgtgtcctcatttgtaaaatgtgggcatttgctaaaaccttatctaagttctaacatccagttctcatatactataatcaatttgttaagatcattaatcggccacaggcctgctctatggtggcagtttgagagtctctgctaagcatcgttattatcgatgcttaaaaaccatagccatagcttggcatatagtaaatgctcagtaaacattgttgactaagatacagaacacccagttagaacactagagtgtgttatatgaaggccaagttgatttagatgcaaaacaggcttgcaggggaaagcctggactcatgaatcataagtgaaaaaattaatgctgtaaattgggaaaaatggacagatcttattctaggtctactcatgttccagatccaaagctgagtgtcactgctgagttactgggtggaatttcctcaagaagtggtcccattagcattgccttcttcaacctagtgatttcttaaaggagattttcatgtccaaacactcagaagttccatggtttgaactgctgcttggggctttttctgtagtctgcaggattaggtaggagatgagaggacactagacaggctctgaaatgtaggatgatccaacagttctgttcattcaacaaatggataccgagcaggcatagaacaagatgttaacagtcatatctgtaacttgatctgtatttactagttttgccatcctacgtcatcattcttgttcctgtgttatttctaccttattttttatgtctcctgtattgtttctatgtctgacaagaaagttgctgaatatattctgtcaccaaaaggaccttctttatttaaagagccaccatatttattgagtctcaaacacataagaatattttaccaaatgctcacttcgggacaagcaatgctcagttaacttaaaagcgaggtcttggaaaagggcaagcaatccaggatgtacatggcagggtggcaagaatattgcccccagtaatctaaagcaaattcataggggttcatggaagaaaaaaatttgaagaaagaggcaatggagcaaacaacagaaagagaggtttcccttaatagtcatttgagacagctagtattacagaagttatgaacatgggtatctgggctataaagaaaaggccataatcatcttttcttattgagataagaacacttaatatgaactttaccctgttaacacatttttttttttttttgagacggagtctcgctctgtcactcaggctggagtgcagtggtgcgcgatctcggctcactgcaagctccgtctcccaggttcacgccattctcctgcctcagcctcccgagtagctgggactacaggtgcctgctaccatgcccggctaattttttctttttttgtatttttagtagagatggggtttcaccgtgttagccaggatggtcttgatctccggacctcggttaacacatttttaagtgcacaaatcggtattgttaactataggcacaatgttatgcagcagacctctagaactttttcatcttgcataactgaaactttatatccattgagcaacaactcgcccttacaatgtatggcaaccatttttctactctctgcttctatgagtttgactaaataatcatctaaataagatgacaaaaagctccgccttattttcactccacttctgaataaaagtgaagataagggattgaagtatcagatacatccattcattgtttcagatagtcaacaacatgaacaacaatattaatttataaatgagattgaataaatttgatgtaaaattgaaaagtaaatgaacatatttcaggcctgaaattatgttttttttttaaaaatctaattatagtcaatgaaaaaacatttttgagtgtataaggggaaaatgtgtttaacaaactctgtgttgagatttatttttctggaagtctttgaaaacaaagattgtattctctgagatcaagggcacgggctagaatagtccagcctgcttgcaggtctgtgatactatggaggaatagtttactgcgcacacagcatcttgaacagctgtttgactcttaattctaaggctgggctgcttccaacaatcactggggaagttacttcctactgacaataatgttgttaagttctgagctgaccttgagagatcactggtgaaaactcaatctagttcccgtggccatttagggaattaggtcttaggtcattaagcctaaactttaagatttggaaattacttctgaaatgttagtagaaatgaatggattattagaaaaccctgtgacaaattaatttgtgtatgttctcaagatactgagccaaaatttgagattgtcaagtataagtggtaaataatatctgaatcataccctttgtgtctgtctatcaacataatccaaaaatggaaccctggttcattctaagcacatacactcaaacgtgatcattcccaagtctttctcagatggcaacatcattattttatttgttcaagccattgacctcagaattttccttgactctttgcttcctctcaaactccacattctatctatcttaagttctatcaattctaccctccaaatatatcttcgatcaaataattattcaccatacctatcatttccactctagtccaagtaatcatttccttctgagatgactccaccaccctccttttctgtgtcttcagtttcgctctttttatagtcaattctccatagcagcaagagtcaacttctaaacacataaatcagatcacatcatccctgctgagagccttccagtgatgtttccttacttccagtgatgtctctttactcacagaataaaatccacctccaaactatggcctgcaagaccattcattatctggcctttccctctttctagaacctatcactgtctactgatcttatttcccttgagatacacagctcatcttgctatttctacaacactcaaaacctgttcttaccattgggcttttgaatttggtgcttcttctgcctagaatcctcttcattcaaggtttttgcatggtttactcactcacacaggttttgtttgtttgtttttttgagacagggtctcactctgccacccaggctagagtgcagtggcacaatcttggttcacttcaacctccgcctcccaagttcaagcgattctggtacctcagcctcctgggtagctgggactacaggcacgtgtcaccacgcccagctagtttttggtagaaacgtagtttcactatgttggccaggctggtttcgaactcttgacgtccagggatctgcctgtttcagccacccaaagtgctgggattacaggcatgagccactgcacccggcctcacacaagtctttaccccaaaataacctcctcacataggccagtactcctcaatctttctctattcatgctttgtttattttctcttcatagcacttactacccaacataatttcatatattaatttatgggtttactatgtatttctgtcactaaaatctaaacatccataggggcagagactcattttgttccctaacatatgcttaacatagagtaggctcttcataaaaaaagttcttgaaagaaccaataaattctaggaatctgagttatggtataatttttcctaaaataatgtttttgggggacaaaaggaagagcacagaaaaaaatcaaggggatcatttgtaattaaatgaataatgtgtgtaaaagtgctttgtcaaggcaaaacactatgcagatactgttttaaagagtatttgtcaggacatcaaaatattttgacaaagtgagagagaagactggtagagaagtcagtttgtaaattattcacatctcatcttgttacagtcattaaagcaaagcagcaattcctagatgactcagttcttcagttttgatgataaagctagttttcagaagacttagacttagttttcagaagactcaaatgcctagaaatgcagttctaaaaataatttttaagtcatttctattcagcatccctaaatatgactgcataggatatcaaacttatacaaaaatgatgaagaatagatcaaaaagacgtctatttcctccaacgcggctaaaaagacaccttagagtagatataactaacagtcaagtggtttagaaactctaagaggccaggtcattgaatgttagaatgaatcactctggccgggcgcggtggctcacgcctgtaatcccagcactttgggaggctgaggcgggtggatcacgaggtcaggagatcgagaccatcctggctaacacggtgaaaccccgtctctactaaaaatacaaaacattagccaggtgtggtggtgggtgcctgtagtcccagctgaggcaggagaaggagaatggcgtgaacccaggaggtggagcttgcggtgagccgagatcgcaccgctgcactccagcctgggctgcaggcgagactccatctcaaaaaaaaattaaagaaaaaataaataaaaagaaaagaaaaaagaatgaatcactctatcgcaacttttggttgtttttcagaggtgatagggaacaacgcatttttcttaacacagagctgacttaaatcttaacattcacaaatgacatccaaagatattttctctttctgtaaaaagaaaacacagaaaactcgtcaagctaacatacatactaaaatgtatcccacgtaagcaggccagcactgataacagaatgagcctaaataaatgtataatctacaacatgatttcaggataattttattgaatttctcagcctgtctctcactttgtggtgacttctgaagaaatcgaacatgcataatatatgacctgacaaatgaacaagtaaactactttattcaagccttttcatttgtcaacagcatccaagcaataatggctttctgtccactcttttaataatgtatgtattgattacttccatctaaatcttaaccagaaaatctcgggaagctttgaaggtatccttaatgatctctagggaagggattatagagatttttttaattgaaagatgaaaacctagtgacaaacaatttcattagtaaaaaggcaaacaaaaagtcattacctacactgttgttacaatcaagatctaatctccatttggatttggggtaggaggaagggagttgaataagctgatgttttattgcagttctccttagaaattccccactatgatttgctcctttaaaactctctctaggttaatcacagaagtagacaagtaataaatatcactttagtgactgctcaagtaaaacaaaggaagtcagtttttaaaatatatctggaccagaataacacccactaattgaaaacgagtcagtctagtgaggcaagtaatgaggaactgtaaaagccaggataatgtattcaaaagacataaaaattggtcagtttatatttgctaaggcatatttgagctttaattatttataacacttcaccgcatctggagcattattttattaattagtcttgagagccattcagttgcagttgttatgctgcccagctggtttggggagcacagatctactcccatgggtgtgaaaattgctttgaggagtgagactatggtccccaaatatgtctgtggagtatcttggaattttacctacagaagaaccatatatctctccatgacagcaattgatattgactgtatattttctctacaagaaaagagtacaagatatgtaatattttgctacaaaatattatcactaatctgaaatggtatacaaagaaaaacacaaattacctgttttgtaaacatcctgatttatagaaaatgaaagtgaaaatgaacaacatttgattttagtttcaactattgacattttaatgggatttgtatccccataaaaagcatcagcaaaggatattaataatttagaatagagagtaagcagatgactttttaaaaaagtggcactctaaatacttgcggaataagtttacaattacagtgacccatcttgataccaaggattctatacaaacaacaattaaatcaagaaacccataaagagcaatacaatgtacaattctggaaacatggcaaagtaaaacaaaagtccacaaatataagatctgtcaactattagatcttgatggaattttgtactgattctgttctttttctctttttctaactgagttcaggagatctgatacgcagatccagtttcaaggattttccattgttcttttgcccataggcttcaagagcatcactaactagacagtccatatatgaaagggctaccacatacatgtgacaaaactttgagtcaaacaggctactaaactgttctctcatcagcactcaggagcgatgatgttgtttgaggaaggagagtgttttgtgtcaagaatttttcttaaagataccaagagaagcttgaaaaagcattgcgccaaactacaagtaaaagctgtatgtcgtatgtttattgaagcaccattcacaatagcaaaggcgtggaaccaacccaaatgcccatcaatgatatactggattaagaaaatgtggcacatgtacaccatggaatactgtgaagccataaaaaaggatgagatcatgtcctttgcagggacatggatgaagctggaaaccatcattctcagcaaactaacagaggaaccgaaaaccaaacactgcatggtctcactcataagtgggagataaacaatgaaaacatatggacacagggaggggaacatcacacactggggcctgtcagggggtggggggctaggggagggatagcattaggagaaatacctaatgtagatgacgggttgatgggtgtggcaaaccaccatggcacatgtatacctatgtaacaaacctgcactttctgcacatgtatcccagaatgtaaagtataataataaaaaaaaacctgtgcatcaaagtagctctacacactttacaaaaagatgcttaattagaaataaacagaaaactcctgtaaataagaagggaataccactctattctttctttccctgctcttggtctcaatagccttcctttatctaaccagtgtctactgtatactaggcactttggaatgtgctgagtagaaaaatgacagctttccccctcccaaaaatcttcttgaaggacatggtttagcaagagtagtcgatatttatcaaatagtaacacatgtacgtgatgacaaacaacgctatgttatagaaaagtagacaattttagaagtgtgtaaagaaagatctggtcaaatgtagacaacagggaaaagtttgcacaatgtccgagccaagatgtaaaggattattagatgataaccaggatattatgagtgggtgggtataggtaaaagggtttgagacagaggaccaacatatttaaagccccacataagagggacacgcagaattggaaaaagtaaatggaggcagtatggctggcatccaaacagcaagggaagagcatctaggaaagaggaggctgaggccagacaagccagatagtgccttgtcacccttgttgaggattttggtctttttccaagagcactgagaagactactatagtgttaagataaggactgatataattggatttatgttttttacacagattattctgactgaaatgtagagattgcattgtagggtggcaagagtagatgcagaaaggttaggagaaatggtcttctataattatgatgataacaatagtagacagtcaaaaacaattttgaaggtaaattggccaggtgcggtggctcacgcctgtaatcccagcactttgggaggccaagacaggcagatcacgaggtcaagagatcgagaccatctggccaacacggtgaaaccctgtctctactaaaaatacaaacattaggtgggcatggtggcgcgtgcctgtagtcccagctactcgggaggctgaggcgggagaattgcttgaaccaggaggcggaggttgcagtgagccaagattgtgccattgcaactccagcctggtgacagagcaagacccagtctcaaaaaaaaaaaaaaaaaaaaattgacccagtgatgtcttggtagtggaaggctgaaggctggtcatccggaaaaggtactgtaccagacaactacattgttgtctggtatgagaaaatatttagttagagtctcggaatatttagctagagttttggagttttgtagattgcagcaacaaaaagataaagaagcaaagggtttcagacttttgaaaacaagttattaaaatttagatgattgaatctaagttgtatttggaaggaggtaaatatggaagggcagaggaactaatgtataaaacacagagtaatcaatgggctggaagtcctgtgaaattcacgaaaggttaacaggtagctatctgagcaagcacactaaccaagtggggacggattaacttcattctggtgagtatcactcataactctagcatcaccatctccccaagtcatgttctttgtcatgagattcctgagtaaggactgcgttaagtacagacattttaccactcttaacaagcaaccaaaactaataaccaggaatagtgaagcagtatttataacaaaatactggctggaagaaaccacagcaattatttggaccaatttcctcatattacagttgaagaacaaaatagcaatcagaatccatcttatgaagaaatatgactagaatctcagtctcctgactcctagtgcacatgtccagtgattcattttctttggtttctggaactagcataaaattcatcttttgtagaaattctgtctcatttcactatatcgcataatgcattttttaaaaaaggcccatccttctcaatgagtgcttttctatatgtacaccagagtgttttggctgtttattcaaagtcagaacatttaaaacacatagcaccattacatttcaccctaccacaaaagctaatttaatattcagaaatatatgaaggcaaatggctaaaggagaaactggcagtttccctggcatttttttttttttttgcaaagatccctgggtcttctttcatgttctcttccctttttataatttcctatatcctcttctccagaataatataaacccttgacctttcctcaagatgccacctttggctgtatctccacagagatctttcctttacatgctcaacatacaaaagtggtaccattttatcaagtttttattatttggtagtaatttgtttggtttgctattcatttctgttcttgtatcttttattctcatttccaaaacacttatcagtatccactctacaccagacactttactagactctagggtcttggaggtgaacaagacaaaatctctgcctttttcactcagagcttagtagagaagatagaaatgtaaataaaaataaaacaaacaaacaaagaaataattggtcatcgttggaggatgctagtgaacaagttgttattataaaaattggtaaaattgaaacgtattttgcttgttcggtatgaaaggtatactgagtaccaaaataggagacaagtgcaaaacatttttttcatagacctaccccagtgaataaatgaagaaggaatggtagagataggcaattatcacactgcaacccctagccactgatcgtgaacagctattaaacatcacacaaaaagagaaaacaaggcattatataccacctcctgatgatggaagaatacacgaacacctgtgaagcagtcttgccaaaaaaagccaaacccaaatacaatcaaactatagaactgcactgttcaatcggtagctactggcaacatctggctactgagtacttggaatgtaatgagcctgaattgagatgtgctgtaaatgtacattttttctattgattgcatgttgaaatgacaataagaattgtactacagttgcatgacatataatgatgaaaagaaacagggtgaaagatacagggaaactattctattttagaaacttactgtgaatctgtaattacttccaaacaaaaagtaataaaaagaccaactaaccaaagtaaggtgtgggtctgatttcaatttttatttaaaccaaaaccagaaaaagtttaaaaaatgcataatatgtatgagaaaaatggaaatttgaatatggactggatatttgatatgatgaaattattgatatttcaaaagcattatagtagcaaggtgattaccttaaaagagtgaatcctatcttttaaccttttgaaatattaacaataaaataacacacgcctgatatttgttttaaaacaatctgggaagagctatagaataaataagatctgacgtgatttgataattgttgatgtcttgatgagtacgagttttattatagcattctgtctacttttgtatatgttcaatatttttcatcatgaaaagcttttttttatatagccaaaagagatggacgatttcttaaagggtattattaacacaaatgtgtttgacatttacagtgtaatggcttagattatttataattgacccttgggtgagaagagtaaaaaagatttctattcaacttaatttcaaacaaaattaattttaaaatagtcactggattactatgtgcttaacatgtgcaaggcacgaggcttaaaaatgtcctaccctatgtacatcgttctgcttctgaactgctggaaagtcgcctccaataggtgcctgccggcttaattcatcatctttcagctgtagccacaccagaagttcctgcagagaaaggtgcagacgcttccactggtcagaactggcttccaaatgggacctgaaaaagaacagcagcgtaccatgtcagaatatctagaagtgtaattgatgattctaacaattccattgaaaaagtacaataaacctattgtgaactacaaagcagtcttgaataaaaatctggctacttacttttgagagccacaaaacagaggatagtttgatggcaattttgagaaaaggcagtgtttagccatatgtttatttccacatgcagaatgctgagacttttggcatgaaatacacactggaatctattgcttttccatactgttgtagtcaacaattcttaatatttctggtagaaaaaattggatgcagtgactaatgaaaaacacttcgttttcatgtgactcatgctagtactggaattctttttgccttgagaaatggaaaggtctctccccacattttgacttttccatttctacaccctaggcagccttttccattgagttcttccatctggcgtctgttcctttctgctcctcttcccaaatgcgtctcctttccccctacccttctttatttgtgtgcacctgggatttgtcttcaccaagtttcaacattttctgctttgtttcctttgtgtaaaaagtactaagacaacaactcacatggaagagtaaaatcagacatttatctgaaagcttcccccgaacatgaataatttaggcaggagactgagtgctttaccgtcaactgtatttagaacacgttaatccttagaagccatttaagaatacacaaatgaatgatctgtgctataaaatccacatttcacttgaagatgagaagctaaattaataaaataaatcatcatccagaaaacaaagaggaaacgcagtgttagcaaagctttatcttcaggtaaattagaaattatgctcaatcactcagctattatcagcaattactaattaattcataataacgctacctataacataaatataataaagactttaacgctgcaaagattgaaatgtaaagcaaagcaaccaggtggagcaacatttcccttagccatttggtaacttagcttgacattacaaatacaattctccttttggccttagtcaaacagaatcaccaaagaatacttatctactgaaattaaattgttccaaactttctgaaggataatttgacaatacataaaagtctttaaaatgtgcaaagacaatgacccacaggcttaaattcaaggaaattatactaacaaagaaattggaaaaagatacaaagatataggtggaaaaatgttatatatagcatcatttatgattgataaaacaaaacagaaacaacttaaatattcaatatgagggaattgcttgagaaatgcaaaaccccaacctactgattgttttcaaatgtaatgaaacttgtatatgctttaaatttagaaattaatgaaatttatatatgaatttaattaaatagctcttaatttaaaagggaattattacatatataatggtgcattcatacagtaaaatcctttgcaaggttcaatatgatgacatagccaaatatttatggatatggaaaaggtcatcatcccagttactaaatgagaaaacaggttacaaaacaaatacattttttgaatttttctaaaacatttgtgtatgtgtatgtatttgtatgcacatgcttgactaggaaaaaattttgtaatgacaaccaggttatccctcagaggtagatttacaggtgatttatttcttaatctttctacttttccaaattgtcaagattttctttctataattgcagtataaacaatatgtccaggaaaaatgaaggcatttccatcaaataagataaattaaattgttccagactctaagggtattatttcccaagaactgaatcgtgaaataccataaatgtcatgaattgaatataatagtgcatgcagattgcatacaattagaggtcagttcttttatgtttctgtaccatcctttcagttaccacttttccatgataagcctaagcgacaattccccatgcaagattttagctgtttaatagcatgtaatgtgtaatggttaaacgaattccttggggtgtctggaattcacagcttggtccctttgagagtgaaaagaggctgtcaagcaggacatattgaaaagtaggtggagagaggtagggctcagacatggaaaagcagcaaatggtagaaaagacactgattaaataaatatttattgactgcccctaagtctctaggatacattggggagtagggagagaggaagggaagagagaatataacgatgactaatgtttggcctctgtctgcctggtagaggaaacaaaatatccttgtggcagagaggtctagaggaggatatagtgaagggcaggctgcctatgttaagacctcaagctgcggctttgtttatgtaaggaagtgctaaaattccagttctaggttaaatggtgctgactcattattagtgggtcaatgaacccctttaggtcccctaagagagagcaaaataactgagacctagggaattcagttcttttttttttttttttttggtgagacagagtcttgatctatcacccaggctggagtgcaatggcacgatcttggctcactgcacctccacctcccgggttcaagcaattctcctgcatcagcctcccaagtggctgggattacaggcgcccaccaccacacccagctaatttttggtatttttagtagagatggggtttcgccatgctggccaggctggtcttgaactcttgacctcaggtgatccacctgcctcagcctcccaaagtgttgggagtagaggcgtaagctaccacacccagccgggaattcagttctaaaggatctaagagaaacttaatagcatgaaatagggaagttgttagaagccagggacagaggacagtcaagagagctaatacagcagcagaagacggacctggaacctcaaaagacgaaaagctctcacatatctgggtaaggggacttcctttaatttttttctaagctgtggagttagataaaatttcagaatgtttgatcatcctaactacatatcaaattgcttcatttttttcctctcctaaagctcaagagtgaaaggaaaaatgtgataggaggacaaaaactgaagcgaaaaacttacaaaggacagagaacactgagtaagaactgaagaggtgaaaggcagccagagaatgaattaaaacagcatatacaaatgtattcaacctaaagctctgggtctcaaactatagtgtgtataagaaacatttgagtagcttgtttaaaattgagattgctaggtgccacctccagactttctataattctatcaacaatctctgctttcaacaagaaccttcacaattccacaggtaagctccagaaccattctttgataaagcatttattaaagcatttctgatatgccccaaacattacttcttggtctccacagggcaaaggtggcatttgtcagtgacttgattttgaagatctaaatgtaaggaacattgtgagctcaaaacattttctttgaccatgttaagcccgtgaaatgttttcaagtcacatttctaatacatttatcggaagcagttgccctatttttattttcatgagtgtatataccagatattttgaaatgattaacctatgtttgcatgtggaatatctcctcctgaaaatgtttctttgtatttgtaatgacttttttttctggttatatcatacataggctgttggggttggaaggaacctgagagattatagttcaaccttcttgttttgcatatgtagaaatcaagattgcaaaggtataaaacagctgctgaaaaacataacttgagctgtcctatttagatatgggaaatagaaattacaaacctttgttagatgagaaaatccttaaaccttagtggttttaaccaaatgtttttgatctctgaacaaaaaggcttgttgctgttaaattaaattaaattgggcctaaagctgactctgtacatagcaaactgcaacccagcttggcatgtaagcaatatgcaacttaagagtacattcttgtaacaaatagctgagcctcagccaatcccagcagtcaagtttcagctaatcacaggctgtaaactgatcagctcatgtccatataaggcaaatgcctatttacactatgcccaagtaaggcaaattctaagctgtaaccagtcaagctgtttctgtatgtcacttcctttttctatctataaatactgcctgcccaccttgctgggtggagctttctgaacttctaattctgagtactgtctgattcatgaattgttttttgctcaaataaactctgcaaaacggaatttgtctaaagtttgtcttttaacattgctaattgtcaaatatattctgcttactcctacccactcaacggaaaataaaagaggtggttcaaaggggcatgcttagcttctatctatgtctattaatctttattagtgaagacaagagcttaggggttactaccgtttaacaaggcaagtgctaatctctaaaaagctgataatttccacaatttgtaaggtttaggtaaaacgcagagcctttagatgtgctggagtatattgcttggtctttaaggaactcctcagtgtcaggacactaagaattataggggctgataaagtgattgttatttctctagacacagatatttcaactgtgatttggttaatgcctagtttgaaatccttaataaaactttactctgaaaggcatgcattcttaaagtgaaatgtgttatattgaattcatttttcactttgacttcctttataaaactaatgatatatccctataaatctttagtaccctcatgtaataaaatagcacttaaacatgcagaaagaaaagggaggaatgcagaaataataaagaaccacaatactgccataaaaacagacacaaagacccatggaaaagactagagaacccaaaaacgaatccacacacctacagttaactcatttttgacaaaggtgccaagaacatacagtggggaaaagacagtctcttcaacaaatggtgcggaaaaactggatatccatatgcagaatgaatctagacccctatctctcaccatatacaaaaatcaaatcaaagtagattaaagacttaaatgtaagacctcaaaccatgaaactactacaagagaacactgagaaaaatctccagggtgtcatcaacagatgaataatttgaatttgtacttcagaaacaaaaaaaattaaagaaccacagaattaaaatgggagctatctctttaaatagagagaatcccaaagagaagtcaacattttttttttctagacaggtcttgaactccaacatccaaacataattaacattctaaaagagagagaaagaaggtcagagatattcaatgtccaagttgcagttttctctcaaaggtagaccccacctctttttgcccttcttttgttctccattatacaaagacactaactattctaacctctaatagcaagcactccccaatagatttatggcttctacagactatataatgtcagtgtccttgcctcttaatgttcacaattgtataaatgtgaacattttatataacatttacaaatttttctgccaaatataaaaatctcacataatgtaaattctgctgaaattatgttgataacatattatgtgattttcatagttaatagtatatacaatgatctggaaaaataatctagtagtagactaaattgaaatcttcatatatatttcttatgtaaaacaattgacttgaccacttctcaagttattaatattctaaaattaaaaatgcaaggattgtggatatggaattttagaatgaaaaacactttctttgactaattaccatcttaatattggataacgtcatcagtaactgtgtgtgtatgcatgtgtgtgtacatttaagtaaataattttctctttttctcccacttaaagcagttaatgttttcgttttgtttgatggaacttaaattatcactgactacttacttttcttccttatacctcttggccaacatgtgatgtaataatgcatgtggaatgatagcatatacttttcttgaattaaattatgagataggattatacaatttcaattaaatttcttttctctcaaagacatcttaattactttatataatgccttttaaatcaatcagttctattttaattaagaaaaccaaggtagaaaaattaaacaattttccaggttcataaagtgtgattgcagaactaaaagaataaaattgtacgattgcaagagaactggaagagactgtccatatttctggtcaaactcttcatttcagtgaaggagaaaattgaagtctgaagcagttaagtgacttgatcaagattatatgctaagacagttagtgacagaatagaacagaagggaaactgggttgcccagctgctggcccatgtctttctactctaccatactcacatatttcgagtttgaaatttttgtattcatataagttagctggaggcagtaagcatagccctataaagcaactcttgaacacttgaagaaacatgttatcaagtgtaaattagaatagtattgggaagacctagtgaggaaacagccagaaaagaaaagatttgttatggaatatgaatcaaaatttggagaataagaggaaagagaatgttgcaagtgtgagaaccagcaagggtacatactcatatgggagagtgaggaaattgttggagagtaggaatggggttagaaaatagaatttattgattctcttggctcagagaatctatgttggggagtaacagaatgatgcttggtgagaaaggaactggaggcagaaaaagaaaagagaagggaaggagttagcaaggacttattaggcacagttggcagagagagaaggttctactagattctaatgattaaatataacttcattagagcagtgattttttttggtatgttttattcatggttgcatcctccgtgcccagaagagtgcctagtacatagtaggcattcattaaatatttgttgaatgaacaaataaatgaatgagggagatatggagacctacaagattgaagctttgaacaaaagagtaatatgatataaacagcgtccaaggtagagtattcttgcaaatgtatcaatatggcataacatgatgacttaaataagaatcttaatcacaggaagagaaaagatgtatggcagaagaaaaataaatggaaggaaaacgatacaatatggacttgtatttggaagcacaaggatatctcttatgagccaatggaatacaaagggaaacttcgaaatcatttggatttaaattcaattttgtttctttaaaaatggacacattaatggttttatttttttgaaatataagagcagtttcagaatcgctcaccaaacaatgggccaactgtaattttttataatatgttataacttgggcaaacacaggcctatttttccagtatatcattgaaactattttttaattgtggcaacttttcattttaaaataacccccatggaagaagtgacaagattcataatgcaggtttatcagtgccactaatggttctatatctaactcttccagtgttattctattctatttcataatcatccctaattactgcctatactgtacttctctcaattgaaccctgccatttgctgtagattgatcaataccctaatttcaatcaagtgtcaggaaataagctaaattgctttgatgtggagaattacttctttgctttttatgagtgcttataacatatcctgtattattacataggcctatataaaagccaaaaccattgatctgaatatttaaattctagaattggcagcaccttagataagctaactgttttctacctgattaatgacagcaagaatcaaactgcggtagctgacatgggaaactgctgagaatgaagagtccatattttggctgacatgctatttgccactttcaattctccttttattttatcaagttcacatgaggcagagaaaaggcactaagtgatactcggaacaattatagcatctttctttttcttttgtgcagaaaagaataacttaacttgacctgccaatattttttccatctcacattttcattcttttttaatgacgaaggttatcaaagtggcctacgtcatcacacatactgacctctcttaagagtttaagctgtagaaagctaatagagcctccctatctttgaaaatgctattgccattgttgctcccagtgtaccaccaccaagttgacacaaaattcatatacaaaatagggagataaggaacaatgtctgggaagccagggtgcaaacttgtgaaaaacaaaacaaaacaaaaccttatacataaaaataaacctgttctactcctagcaatctacttctcataaaaacaaatccttttctactcctagaaaaaatctactctctatttcatcctttcaattagtatgcatttctttgtagaagtttccttctttctttatatgctacggtatcatatggtggttaaaagttcagactctgaagtcagactccctgatttctttttcttttacttttttcttttttcttttgagacagagtctcactctgtcccctaggctggagtgaagtggtgcgatctcggctcactgcaacctccacctcccgggttcaagcgattctcctgcctcagcctcctgagtagctgggactacaggcgcgtgccaccatgcccagctaatttttgtatttttggtagagacgggatttcaccatgttggccaggatggtctcgatctcttgacctcgtgatccacctgcctcggcctcccaaagtgctgggattacaggcgtgagccactacgcctggcccacccagactccctgttttcatcttgtatcttccacttgctaagtgaccctaaggaaattatttagcctctctgtgcctcactttcttcaaatgtaaaaagaattcaataataaaatctacctcttagggttgctgagagcattaaaccggtcaatgaatggaaagtgcttatggcattgcgtggtatgtaggtacatcatgtaaatattagttgctatcattatttcatacttgatgcagacatttacaatagtgcttctgaattactaaaaatgcagattttcctccttatagaagtatatatgttaaaattttggacaagttagaagaactataaagaagaaaaaaaatctcccttctgtaatctttctacctagaggtagtaactactcccgtcatttagtgtatactcccataactattattaagtccatttggtcatcttctacctcccttcattatcactttttctctagacacagaagaaagcacaaaatatttttaataaagagaaatgaattaagaaaggcaactgcttagaaagcaggaagcctggctttcattccccgcccttgctagatcatttaagttacaatgggcgttttacttactatctctatccttttgttcctccacggaactattgcaaaactggtataacaagaacttccctctgccctttttacaaagatgctatgatgcatccattaactaacttctccaaagaaagctggcacatagaagggggcaaaatataaagtatgtgagtatactacaactaaaagcttagtttacagaggatgtgttttaacaaaatctgagaggaagcaaaagacaggaagttgctatagtctctctttaactgtaggagctatctcctctaaactgttaattataatgtgttacaggttttatattatataattgtaatgtgttataaagggttttaaagactgtcctctggtatgcatttagactaatgccaaaaataattccataatacatatccgttaattttttatcactttttgtataaccctgtgatatgccaagagagaaatttatgaaactagaatagctgcactcctcatttaaattcactctgatgtcttaatatgcatgtctcctatgtttataaaacattaccactttaatctaatctgaatcctcaagtatcatctccataccaagcaaataaatgattcatttattcaaaatacagtgaatcattctgaaattggatgatttacgtagacatgtgagataccagttacttgtgctaagacaatgaggaaaatttggccattttaattcatttgtggcctttttgctccacatcttttcctacctaatgttgagagactttttccgaagttcactccacttgaagttcatgttatccaaacgtctttgtaacaggactgcatcatcggaaccttccagggatctcaggattttttggctgttttcatccaggttgtgataaacatctgtgtgagcttcaatttcaccttggaggtcctacaggacagcaggaagaagaatatgtgcagaattaccaaacaaaagaaacaagcgatgaatgtgaatttggagaattgcaaaatataaataattattagttcaaaagacatttcaatcaggctaaactaacaagaagatacatctcaaatcccttttcttggcgtattgccttctcctgttattatgtagatttaaaatgggcatcttattagttgtaatagatttattccttgccattatgagttggaaagtaatgtatttataactttataaagttcacaagttatatcttctagtctatggacaaaatgtattattttatggaagtgataggcaataaaattctatgataaagtgtaccccagtgccaataatttcattactatatggatcaagtcatattttctatttacgtagtaatctgtagagttaactctgaccataaaagcgtggagagactaataaacaagattgcacttggcccacagcaccagcacattcctgggagtctgtcatgggagagaaaatcttcttgacaacacaaattaagttcaccttggtattatagcatcatacatatagtacagcatcatacatttattagttttgatttcccatttaatacacatttttaggcttgacaggtggaaagtacataggaccttggtaagagttatgataagaggttatgcattcaacttcacttgtatacacacagatcaagaaaattattatagtagaagaatctgacctttacatggtatgtcttcctgtgtaacattttcagcttgaaccgggcactacagcactgatcctgttgcatagcaatcctgagaaaacccagaaactgaaagagccctgctttaaaatgccaactttgcttacattctgttgacagaatgaattttggagcacaggcctcaccagtcaataataataaacggccactttgtactccgcactaaacagtagccaggcgtgtggatgtgggaggaacctcaaagagaggaggcctggaatatgcaactgacagtttatattaaacagccaacttttcttatcattctgccattacaagccagagacattataaattcattttatatatgtgtttccttccttgttcccagcagaatagtcaaagccaagggaacattcctcagagagctgccgggtaccagcattcctttctgcctacacaatgaatggaggctttgtatattatctgacttgctcttagagatttgtatgcttctgttcaacaagtttaaaaattcattctgaagctccaaacaattggattgatctgtgtaactagaaaagttttttttttctctctctctctcaaattgaattaaattactctgctaaagtaagggagaaaaagtggcagaaataacatgttagaaattctgaagaactggctcaagttttcagccacagcctcttaagatgcagaattctgaatgttgaacaagtaaggtagacagacaatgaatgtctattgtcactatttttggcagctaaagcatcactgatggactctaaagagagttgtgtcccattctctttgactgggagacaggcaggggaatatggatagaatcacatcagaagttgaaagaagggaaatactgaaagtatttctgagtagtatctctgagtagtacaaaccaggtttgtactggaaggatatagcctgattttgaaagtagtttatatggtagaaggttagtattgggattcttgcagaacgaagtttggtcaaatatatagccattttatgtttttctttcttttttccttttgcctacgtggaataacatgcctgcctaatttgcacttcttcagcaaaagagaaaagtgagttaatttatctaagtacttcaggagaaaaagccaaccagatctaagttccagataattccttcacttgtcttttactttacttcttctgttgtacttgatttgtacagtactttccttttgtgtatgcacttaggggattaaagacaaacttttagttgttcaagtaaaagtattctcactagtagcatcagttttctatgtttactacattaacatacatataaaggatagtacatttgaaatttatatcctacattgatagcagagacccaggctcaatcacgagctccttaaggttatgtataccatgaagtcaccaacactttctttgtcttctcaagcataaataggatgttgattcatgaatttgctacttttcatctttgccatatatattatactgcatataaacatctttgttgtattatcaacaaataaatgaatataaaattgataaacaagcatttattgaggactgatttattgtctagttttagcactttgggaaatgtaagaggagtacaaatgatagttctgtctttaattttcctaaaacctagtgtgcatttttgtttaattcgtttatattaccaactaaatattgacggcaattcctgccaagtcttcatagatactgggataaagactccttcctttagaaatgcagaaatggctaaagttatcttagcattggcaagaagataagtcttctgtcagtactgcttttctaggtcatgatggtgatacagagctgtaaatgacacgtgtacagtaaagggctttacaggttacaaagcacgtacaaatgtaccaccttagttattcctccccctggctctgtgaagtacatcacattttctgttttgcagatgagagcactgagactcggatgtttaactgacttgcctaaaagccatatagctgataagtgttagaactgggaaatggatccaattctcttgattctagaagatcttgggctgcctccaccaacccacttgccagaagcattggatataatacacagtagtcactgaacctgaacgaagatactacttgcaagaggaaataagtgactgttgagggaaaagcaccctgaaagacagcattcttgagtttgataaaatgtttacccacgtggattgatttgttctgaatgaaaaattgaattctgactgctctttttttttttttttttttgagacagagtctcgctctgtcacccaggctggagcacagtggcgcgatcttggctcactgcaagctccgcctcccaggttcacgccattctcctgcctcagcctcccaagtagctgggactataggcgcccgccaccacgcctggctaattttttttgtatttttagtagaaacagggtttcaccatgttagccaggatggtctcgatctcctgacctcgtgatccgcccaccttggcctcccaaagtgcttggattacaggcgtgagccaccacacctggccctgattgctcttttcacttctcatttagcattgggcatcctggaccacctgtgagcaaaaaatgttcacactgaaaaggtctcctttctgcaaatttccctgttgccagaacagaaattctgccatcagtaattcatctctttgtctacaagagccatgtggactactatgaaccataccaagaaatgacttgacacatcagcataaacatagttcatccatgttcctttgggatggcaggctggtaggaaatctttcaagctacaggactcagataggttgccctaaaaggaaggtaagtattgggaaagaacccaaggctctctttcaaaagctggcatgctgtagtggagatttttcagtatcaataaggcagcatgagtcatagattgggaatgcagggcaggctgcaaggaatatacattatacataatataatataatataatataacataacataatataatactaccataatgatatttgtctaaactcatcattttttatttatttatttatttatttattattattattatactttaaattttagggtacatgtgcacaacgtgcaggttagttacatatgtatacatgtgccatgctggtgcgctgcacccactaactcatcatctagcattaggtatatctcccaatgctatccctcccccctccccccaccccacaacagtccccagagtgtgatgttccccttcctgtgtccatgtgttctcattgttcaattcccacctatgagtgagaatatgcggtgtttggtgttctgttcttgtgatagtttactgagaataatgatttccaatttcatccatgtccctacaaaggatgtgaactcatcctttttttatggctgcatagtattccatggtgtatatgtgccacattttcttaatccagtctatcactgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtagaagtgttcctatttctccacatcctctccagcacctgttgtttcctgacttttaaatgattgccattctaactggtgtgagatggtatctcattgtggttttgatttgcatttctctgatggccagtgatggtgagcattttttcatgtgtcttttggctgcataaatgtcttcttttgagaagtgtctgttcatgtccttcacccactttttgatggggttgtttgtttttttcttgtacatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattctggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgttaaagatcagatagttgtagatatgcggcattatttctgagggctctgttctgttccactgatctatatctctgttttggtaccagtaccatgttgttttggttactgtagccttgtagtatagtttgaagtcagctagtgtgatgcctccagctttgttcttttggctcaggattgacttggcgatgtgggctcttttttggttccatatgaactttaaagtagttttttccaattctgtgaagaaaggcattggtagcttgatggggatggcattgaatctgtaaatcaccttgggcagtatggccattttcacaatattgattcttcctacccatgagcatggaatgttcttccatttgtttgtgtcctcttttatttccttgagcagtggtttgtagttctccttgaagaggtccttcacatcccttgtaagttgcattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacgatggggttttctagatatacaatcatgtcgtctgcaaacagggacaatttgacttcctcttttcctaattgaataccctttatttccttctcctgcctgattgccctggccagaacttccaacactatgttgaataggagtggtgagagagggcatccctgtcttgtgccaataaactcatcatttaaagactacacctcagactcaggtagcacaaaagagcaaaagattgatatggagaatcaagtggagttctcagtgggtagccaatctggacaaaggataattttcatagaaatttttggatagttttatttcacttctgacttaactagaaaagatcattcaagccttcattactgcattcactgtatgctctctaatttttttcttcttttttgtgattgtagtctttaggaaaagcaataacgaatgaacaaaggggaaaaggtagttgttacataacaaaaaccatagcagcagcagcagcagcaagaacaacaacatacatgaaccttactgtacatcaggtgctgtccaaagcactgtatatacatgagctcattttctcctctcaacaaccctctagggtaggggctactattatcttcattttccatataagataatgaaactactgtaaggttaactaaaaatgcccaggttcacacagctaataaatgcagcaagatttagaacctcgtcagtcagacttcagggattgtgctcttagccactaggctatattacctttcaagtttagttgttggtggtagtttttcctattaataatgctactacctaaattttagcaaatctagcactgccattagaaaataaaggataactatgtcagcacacaaagagcaatttcatggtcttattaatataaagactattaaacagatttgtagcagtggatagagatgcatccaatacaacaagagaaaacacaaagtaattgagaaaatgggtgcaaacgaaacaaataatgtgtgtccccataaaagaaacatttggcctaaagttctgtacaattatagagcaaatttcagctgagagtaccaaaaaagttcagttatgagacaagcaatatgttcacagtatagcagttttaggagtaggggagatcctgttttctgaagggctttttcaaattccacacttccttcttatctgagtctcatctactcttgttgtgaatctcctttctcagcttccagagaaaactcatggcaaagtgcagttaaatagacataggtttgacccttctcttctctttcccttattagccacataatgatgaaaactctttcattactttggtttcactaaacatgaaataataatacatacctgctgaattttttgaatattacatggaatttttgtaaaatactttgaatagcgtctagaacacaagagatctttaataaataatagcaaatgcagggcttactattacaagataatccatgtggaaatcagatgttagaaatagatttcatgaagttacaggacttggcttgagccttgagggatgtatacgattgggaaattggaacaaaagaaaatattccaggtaaaaagaatagcatgggaatggagtaaaggtgaaatgaatttggtttatgagcagggacaatgaattgcacaacctgattggaatggacaatgagagttgagagaaataggtagaatgcagaccaactgcttaaaccaagtagaataaagtcttcctttaggaagccaccgagaataaaagtttagaaagaaaagtacaaagacaagattatcgaatattaaatttgtactatttcattcaaaaagtagaatgatccatggtgttcataagtaataatacaactggggaagaataggaaaagttatggatgttttactagaagaaaaataaagaagggagatgtcaagaattagtgctgtacccttctttttattattaaccattttattaaccattaagcagatggttgtgatactattctagaacatcatgaataatcgtatccacatatttcctttcctatgtaaatggaattattggtctctaaaataggactcagcaaatgaaaacttccccattttaatatagctgagaagtaaggaaacaaacacaatggtgtagaaagaataacaataagtgaccaaatctccttaagaattttattatagacagattatctctaagcttttctgaaagcagttagtatatgaataattataaggccattagttcctccttactgataatttttatctaatttaaattagcttgatgggaaaaaaagtggtctgatttctaagaacttagaaggtcaggaacatacaattcaaaatagtaaagaaattatcctaagtggctaaattgagagtaggaagaagtgacaccttacagagaatcagaaaggtgtaaaaggagccatgggcatgcataattgaccagggtcacacagtgtggaaactaacagctctccatgcatcagtagcccttgaaggcatcacctcgttttatagcgaagcaaaatagttaatgctcaggatgatgatgctgaattagccagggaaagcagatttacattcagtaaaatctgtttaagaagaaagcagtgtatgtaaatgcttcaaatgaccaaatgactgttatttgatacagttgttttgaaaaggtgttaatgatttaaataaaaataaaacaaaaacaattatatgaaagtagaactcccttagactggttatccaacatgactcattaaacatgagctctaaatagtagagcttttggagcacacttgcatacactcatacgtatacacacacagaaacagatattctattatgaagacataagaacagaaattgaaagcaaatctttagaaacgtgtacagcaatctaaaaataaaaagcatcggcttaaattttgtatgtctggtatttgtaatttttaaaataattcatttttattgcatgttacaaaagtatcagtctattatggattgggaattaaaacaagcgcaaaaaaaaaaaaaaaaaaacccgaagtggatctttcctaacaagtttttcgagaagaatccataggaagaaattggacccacagtcttggccttatcaggattctaatctaaccaccggaggttcctaaccagatcagaaaatgcagttggatacagactcacaagagggtgtgactgttttttcccttcttattctatatgtggccacgcaacacctttaaaagcagcagagttgtcgtcccaagagaaacaagagttaatttgaggactgctgtttggcttggagcctggttgctctaggtagataaggagtatgttttcaggtccactgcattgcgttgcatcttaaacgagcagctatggatttaggagtccacaggctttgctttaaaaacggctgttattaaagtcctcagagactattatcctgcagggtttgttgtctttgctttcatatctcattcgaaaattctcacacttaagcactgcaacagcagagagaagggatatgctctctcagcagggagaagggatatgctttcttgcctcagtatattcccaagtgcaaagcttcatttcaaaatctaatctttaaaaatgcctggcctagggtggattacccccggaggaaactgtcaaaccgccttaagcaatcccgaactctggtaatacgtgatgctttctctccttgtgtgaccctctgactccattcttaagattaccttttaaaactgatgagttcatttaagatctcctaggttggaagtaagatgagaggtatctttctcatctacgtcttgtttttcctagtttcttctcatccagtcacaatgcaaaaattcccgaatatttattcatcacaaaaatgtgcattaagtacctattgtatgtctataagtagggccgataatacctaccttttaaggttttggcaaagattagatgagatgatgtgagtagatcaaccaagtacctaacccaatgcctaacctattgtgaggtttcattaatgttgcatccttctagtccccctctcactttctgccatgactccaatcctgctagcagagaagatatgaggccgttcaaaagaaaacgaatacctactgcatgaagatgggagccagagctacaggcaggagctaagaggtagttctcaggaagttcaggttcaaagggtacagtgtagccaatgagagcttagaatgccgcctggagatttttatctgattctgtaaggataatattccactgtagcttcttgtgtaaaggtgtaacattgtgaaaatagcatctggtaatgattattgggaggatggtgttcagggtaaatgtagcagggtcagagtgaaggcaggaagtctagtggacaggcagtcccagccatacaggaaccaaaacagcagtggcttcagaatcagagagaaggtaaagaagagggatgctaccatcattgagtgctcataagttataaaaatagctgcatgtgtgatttaattccatccttctcttgtcctacctttggaaggtagaattcaggaaagtgataactattcacaagtacattttaaagatagaaatgttatttaaagttctatttctcaaggagtaagaaaaaaatacatatgctgtgtttcaaacacacacacacacacacacacacacacacacacacacacacacaccttggggccaaataaattagaatgacaaaaccattgacaccaaatgacaagggcattgacatcaaagctccatataggcacaggtgactcccacctaaaatataccctatcaagcattcctaaactatatgggtgccagttctaaaggacacaatttcctgagaaaaagtgggtagagtaacactgcttcagatatttttaaaaagaagccgtggacccagtggagaactaatgttgatattcatttggctctgcacataaactttaaaaaagaatggcatgccttttaattctggtgttgaaagagaaaacgagtcttaaagacaggctgagttttctttttttaatactgcatctaaaatccatagaaaatactgtgctgcaatattatttctgatattgctatacagcctcagtgctcataattgggtgagcatttcctgcatgagacatctttcagatcagtgccaacagtaatcttgaaagaccttaacatgcaaaccctagattgtacatttaagtcacagagacaaccacatatgaaaagtctacaatgttgaaggtacttttggttttttatattatattttatgtgcaggaatcagtctgtttgaagaaaactacccttatctgagaaagaccagatgggtctttccaactctgagacatatttgtttttgcagagccatgatgaggggtgggggtagggtagggggatgaaacagggcaggaactaatacttacagcccttataaatcctttacaccaactctatgaaataggccttctttatcccctatcgaggaaaccacgagtttgagaggtaaagtaacttatacaaatcatagagttgttgttatgtggcagaagcagggttagagcatagatcttcctgaaactaggttatttttattctcttccctccaagctccagtgtcttccccatccattaaatacaaagcaagtgacttctgacttgggctacatgtatcacagcaacataattataataactcattaaggcatctgtgagatatttagtttcagagcactgataggaatggtcaacaactgaataattttccaattaggtattgcttttaaaaatttatccttagtcaactcagaactaatatcattgatgtttctgaatggttctaaatgaacacaatacactcctattcttcaaataggtaactctcttcccatggaccaatacatatttggttatattaatctgtgcaatttgtctatattacatagagagttaaaagctcgaaaagctcttatttctggaatctctttgtcactaagctattttttgtcctccagagaatcactgtggttcaaggttgtatattagaaaaaagcaattagttgatgtcaagtctcatcttttcccaataacacatatctaagaagaaagcaagaacatatggcaaagtgccataattatttttgatcatacactagaaatcacaacagccatgtaggtaattccctctggcttgttttaattattagggttgtaaatgcaaacaacaacttcattctatcccccactttaccccctaaaaacctcaaaatactcccacgcaaccacaaaacaaccctacactgatgtaattgtttacaataggttaatgataggaaaatctaagacatttctatttttttcattttaaatagcaggacaatttccaaaataatcacagacactcatcagacacaactgtattcatttgtgggtactctttagcccacagcatagagatattaaccttaaaactatttctaggtattcataagttttgaatgttaaagaaggttctagtaccatgatgtaaactaaagtcctgctgatataattggatctgattctctggtgatcttcagtgagttaatttctgtctactaccaagtagagcaaattctttcttctggagagtgtgacttttgtgtgtgtgcctagatagttctttcatcctattttgcttttcttctcttatacaatagggtgaacagtgatggggagaaaacaaagttactcttttgttaatgtatgaggaaaaggaggaagacaggggatatgcatgtggacactgatgtaaaggtaggtaatatttggcatatttgccgggaaaaaaatgtcataaaggaaaagtaggcaaaatgctaaggtacatttcctcattcttagaacccattcatgagctttccattgtgatatggtttggctttgtgtcctcacccaaatctcatctagaactgtaatccgggggaacctggtgggaggtgattggatcatgggggtggcttcccccatgctgttttcccatgtgatagtgagtgagttctcatgagatttgatggttttataaggggctcttcccattcactctttctctctctctcctgctgccttgtgaaggtgcttccttcccctttgctttccaccatgattataagtttcctgaggcctccccagccacacagaactgtgagtcaactaaacctctttttctttaaataaattaccccagtctcagggaagttctttatagcagtgtgaaacgaactaatatacatcgtgtatctattaattcttcccaaagcattcagttcagttcagaagatgctagagacccttagaccatctcactgaagcaggtccagggtattttttgtgtccttgtgccatgatgcaatgttcttttcttcttctttttttttgagacggagtcttgctctgttgcccaggctggagtgcagtggcgcgatctcggctcactgcaagctccacctcccgggttcacgccattctcctgcctcagcctcccaagtagctgggactacaggcgcccgccaccacgcccggctaattttttgtattttaagtagatacggggtgtcaccatgttagccaggatggtctcgatctcctgacctcgtgatctgcccacctcagcctcccaaagtgctgggattacaggcgttgagccaccgcgcccggccgcaatgctcttttcaactgagaacaagtacatttggaaaatcatccccaaaagagcaaggtttgggaaggcttaggcctttccatgcccatatgacatgttatataagtcttatgaagaactagaacagataagaggatgactttacagattattttacaagaatttttacatgagaatgacttttttttttttttgagacagagttttgctcttgtcgcccaggctggagtgcaatggtgtgatctcggctcactgcaacctctgtccccctcctgggttcaagcgattctcctgcctcagcctcctgagtagctgggattacaggcacctgccaccatgcccggccagtttttttatttttagtagagacagggtttcaccatgttggccaggctggtgtcgaactcctaaccttatgtgacccacctgcctcagcttcccaaagtgctgggattataggcgtgagccactgcacctggactacattttaataacgattaaagaacagtggaaatctgcttcataacaccctgagtaagaaatgagaaattgtagctgcatatcagcattgtcgctgaccctgagtataaacgaagaagcctcatggtgacccaaacagagaattgttaactaagtcatgtccatagtgctttaccatggacaaatgtttttgatccacccttctaaggcaggggtagaaaagctgttgaaatgttgtaaatctctgcttgagtttgtgatacggttttaaatttagcagaaaaatattcaccaacaggagaatgagaaaccaacgtggataattattaatgttatcctgaacagaaaataaaaagacttgctgaaaaacctttctgcctggttttgtcagagttctcttccttttacacattcactttttgatgttttccttttgtgggctggcagaaagatgggggtcactctaaacttttactaaaaatactcttaaaactacaagatgtaagttctctattttaaagagcccatagccttctgaaaaagtcttaagcaaataaatgaaccaaaataacatgtgatcatgttaaactggaacacagccctgtgggaacaaagaacaattagccttgccccccaagatttgcagatgccatcatacaagtgatgatatttgatcagggtcttgagggatgagtagcagctggccaggggagaagtgggagagtgaaatttgaagcagtgggaaaaacatgaatgaagttgaagataagacgagataagaatacacatcagagctaagtaactccggagggaagaggggaagacccatggcgggaagagagacagagtggtaagatcaaaatttctctctctctctctctctctctctctctctctctctctatatatatatatatatatatatagctgcacaggaaggagggcctggattgtgaaggggcttgtgtatcaagctaagggtttggactttatcctgtgaagatgtctaatctgtttaagattttttggtaacatcatcttggtggcagtgaaaaggtacattagaggcaagaacattagaggcaagagaatatggagatctaaactgaggtaatagacacaggatgagaaaaagggagatatttttgagagatcatgaatacaacttagagactgactgaatgcaaggataacatatagggaggcaagttgggtttctggcttagagaagaagatgggggtgataatgctacctattattaaagtgttgaatttccaaggagatgtgagcagtttaacataggcttagcctgtcacttagtgatagggtgtggaagggagagtggtgttgacctttgtcggggggtacgtgtcatccactcatgggcatggtagcctgaaataggggcggtaaagaagggcccagcagggagtcagacagtctatgttgtctttcttgctctctcaggcgtctgtgttctttgtgtcattcacacgtgcctgtgagcgtgaacttgcatcatgcatcagtagttcccttagtacagtggttctcaaacttgagtgggcttgagaatcacccagagggctcattaaaacacaggctgctgggctccactctgagagatcatgattctgtatgtctggggtagaactcaagaatttgcatttcttagaagttcccaagtgatgccgatactgctagtccagagaccccattttaagaatgaaacactgttctagcataacagcccttaatcttctggaggtcatgaatgcctttataagaatgatggatcttctcctcaaaaacctgcagaaatatttataaacacaaaatacgacctattacttcacgggcttctgctactgccacctccacctccacccccgggacatacaatggattaatgaagacaacgtatccttccagtaccattttaaaggagaacccccaagaagaagaatacattggaaaatggcaccaaaatgtgattttacttatttagttgtcttagaattactcccagtgagcctacgtacaaaatgacccgatttggggaaggagacctgtcaaaggacagttcttgggtgcaatgaggaaattcatttcactctaaccacattcagataacctgaccttttcccattttaacctgccattcacttgggaagtaacaaataacagagaggtgggtgggtaaccatggagaaaagggtgcattcagccaggggcctgcctgtggaaggacggagcagtttgcacctcggggaaagcggaggtagggctctaggctctctgtctggtagcccagggaaacagttcaagatcaaaggaaaagataattaagaatgtgcttaaaagaaaacttcaaatcagctgtgctacacaaagatatgagacaatgcctgttgtagagaaaagagcattttgactttaccctaagaatctttcttatgtgctttccatagcccagcggtatagttatttttaaatgaccctggaaaggaagcagaggtgttctttattgcatgaatagaaggcaatctttcatttaaagaaccttaaccccgctctgcatgcatgcatgaagtcaggaacacaagggcaatactgtattattcattttggcaactataaattcaaatgatggctctgaggttggggagaaaaaggcccgctgagctggagagcagaacgcttccttcagcttatcaaagaagtgatagtgctacaggcaggagtgccccataataatctagggaaaatacgcctctgagtcaatgaagattttctgttattgcatgggctgttttgcctacagccaagaaaattctgtctgatggtaatgttttagctgctgattcatctcctctgtcttcaattcttctcagcaaacttttattgggtctcatcctgggcacatttacagagcaatttccataatgataacatctcttcaaatgagatttaaagtgtaattaaaaggcacatgtgttgtggcaaaggcgttgttgtgcagtgaccatacatcatcgtgccatggagctctcactcagccagcctatggaatgaccccggtttcactctgataagattccatggctttgtttgaggctaatggcttcattagaaaaaataaataaataaaagaagataaaacaagctctttattggagagataagtccatgaacatgcgttagacttctgcacccttctcccttcgttctgtctcttagaactcagaggcaacaagaaactccttgagcacggaagtgaacactaacaaacggacaggtgaaagctgaaaggatgtgcttgccctgagaagctgagctccttatgtcctatggcctactctcatggttttaagtgtgattgctagaaaagtggaaactacaggttacaattccctgaatggatgaatgcttgctcctgaaaaactgcctggtgcctgagaaagcaaggaaatactccttgagtagtcaatgtttgaaacctccaaagtagctaagactatttcttcttcactgtaaaatcaatataagatttttaagctttggaactactcaaacccgaaaatagcttgcctacccagatcctgactcatagtattcattaaatgatatgaactgattttttacttggctgctggttttaagtattgatagataatcatatcatatgacagggaaatcatattaacacatggggcgaataaaatctttcaaaagatcagttttgagatccaagatgatcattaaataatagattctgaagcatttaaaagaggacttggaacttttaaatgccatatgttcgatcacctttttaaaacataacatgacaatattcatggagactcaatatgccatgtaatgtctacgttacttacagcagagagttccactaattttctgtgctcctttctttgcctaaatgaactatttcatttagcacaatattttgtttgtagaataaaatttatccttgtgatgttgggagttatgaaataactcatgtgttttaaaatatcattaaatgtacggaattaaactataattagtagaaatcatttgagggtctttaatttactgatgctgacaaattctcatcaaatagttactgtgctttcaagtaaaataacatctttgtaggcagatgtaagacactagaaaaataatgtacactttcaaagagaaagtgaacctcccatacctctgaaataaaagcaatttagaaatctgatatattttaaaagaggcacataagttaatctgtaaatttcactttactcgttgacggtgaaatgctacgttcaatctgttgttacagcaaaaagttaatggaaagtttgacttcactgtaacaatatcctcttttaaccaaataaccttccttaaaccttggataaaattcccctgtttcacactatcaccatcacagataaacggattgaaaagacaacaccattctcagtagaactgtttgcttacactcagttagccaagcttctactacctgatttcattgccatggaaaatcctccaggataacttgggtagcagctacctctattacttctcccaacatcccactgcttccagttgctactgtttgctgttacaatcagtggtagcctagaaacttgaaccacccaagtgttttaaatgcggaagagaaaatctgagggaaaattgggaaggaaaaagtgtttccatgtttccgaagagcggcattgtgcttgtatgactgtttttcatcagctttgactttttggagaggcagttttacttttcatagctagtctaatatttcttctcactaaatagtgaattaacacagtgcaaatttagcagtcatccttttgacatctttactcataaaataagtaaaagcaatccccaacttacaaagagttctctaaccaaaaatcacttgcaaataaatggtccagaaccccaaactcaaatttccatggacacaatagtcatatacatgtctcagaccagcatatacatatatagctatttaacctataccatggatgatttatatcattttgatagcatgactttgggttatatgatttgggaaatatgcatcttttgggatatgaaagattcaagaagtacggaaaagaaatacttcctattttaagacctggatttgtccaacacccaacaaaggagatatataaatgggcatctgctctctccttccaccttctggtgcccatattttctactcccaaacttccttatgttttaatcctcattctcttctatctgttgaaaatcttattcccaaagtatagactgacaactttcacattctgggagatttttatattttaaaaagaggggctgggcatggtggctcacatctgtaattccagcacgttgtcaggccaaggtgggtggatcacttcagcccaggaatctgagaccagcttaggcaatgtggcgaaactctgtttctacagaaaatacaaaaagtagcggggtgtggtggcacgtgcctgtagtcccagccacttgggaggctgaggtgggagggaggatcacctgagcccagggatgtcgaagttgcagtgagccatgattgtgccactgcactccagcctgggtgacagggtatgaccctgtctccaaaaaaaaggggaagctgagttaaaccaaaccaatctgaatcacagattgataggatttccaagaatataagaatgcaaagtaaaaatattcagatggtagcataagcgtctgggggcagaaaggctttagctattcttggtaggcaatctactttggttaatactgtgaactggctcacctaaatctacttaccatccttccagttggacaggttggaaattaaaaactgtatttgccagacttccatgcagctagtgttctgattatgaattaggatataataagttagggttgtcagataaaatacaaggcacccagttaaatttaaattttctacacaatctttttttatttagtgttaagtatgttgcatgcattatttttatttgctaaatctggcaacgttttgccaaatgtgtatacttgtgagagatctggaaagtggaagtgaggcataggtcacctttctgccccttttggctatttctgttggcgagcttagtcaaagaaacatgagatttcctacatcagagttccaaagttctttctccagcttcctggctggagaagggcagttgctaacagcagcttcaaaagtggtagcgtctagatttcaacctcctggttcctagttcctatttacaaagtatgttcttgaaatcattgcttcagtggtaccccggagatggtagtttcttattggatcagttctatatagttttagaaatctgtcctcgaagccaagtctaaaacctgctactttagcctttccaaaactttgatatgtgtctaacgtacctagagtagtttctcttttctgcagtgaactccgttatattgaccttcagggccacctcctctatttgtttctactacttgcaatatcttcctttagtcattaaaaaaatctacaaacaatacaactttatggttttcttaacatggttctttgtcacagcagagatttcccatcacagaaggataggaattgaggaaggcaagtggatttgtacctatggagagatgtcttgttttatttattttatttctaaagaacatactttacaagacactttaggttgtaacagtgcattaaaatacctaaacagtataccagcatcctttaggaacactttactattatttttctcatctcttttgtccctcatatctagatgtcaaatttccactgacaagtaatttgatgcctagggaaaatattcgattcaacagtttcataacatgatgtcctattaattaaaacatgatacactgacattaaatttccaaatgaaaagaagcccagaagtgaaatatcacaaacttgatacatacgtatagtcacatggaggggtggagggatactaaggaaagacagtgtgttttcaaacctggcttgcacgtgtgaggtgaacactggagaacagaacttacctctctgctgtcagcacttggaacagcactgagcgcactcgaggcgctcaataaatcgagcttaattttttaaatcttttcgctcccttcgcccattctgcatatatctcatgtacaatttcatttcccaaaagtaccaggttctaacatcaggaagaaaatatatggtgagtattgaccatttctggtggtcaaggtctctactcttaatctcatgtaattagggtgatcctatagttcattgtccaaacctgaacacttttgagagtgtccaggatgctaataataatcacacagggtcaggcacactggctcatgcctgtaatccaggtgctttgggaggccgaggtaggagtattgcttgaagccaggagtttgagatcagcctgggcaatgtagcatgactcttatctctacaatatgttttaaaaattaaaaataaaaataaaaaaacagttaaaggagtttgagaacagcctggccaacatggcgaaactctgtctctactaaaaatacaaaaattagcagggcatggtggtgggcacctgtaatcccagctactcaggaggctgaggcaggagaatcgcttgaacccgggaggtggaggttgcagtgagccgagatcgcaccactgcactgcagcttgggtgacagagcgagactccatttcaaaaaaaaaaaaaattaggtgggcatagtggtgcacagctataatcctggctactcagtaggctgaaggaggaggattgcttgagctcaggagtttgaggctgcagtgagctatgatcatgccactccactccagcctgggtgacagagcaagactctgtctctaaaataaataaaataaaataaaataaaatatagtaaagtaaagtaacacaagaataacagggataaactgggacagccggagacaaattaggatagatgaacctatagcagtcaataaaatgggcaaaagggtctcagtagcagcagaggcagcctttcttcccgctcattctctccaagtaacaaaaggtctgtgacacgacgttctctttctgcctggggttcactgcacgcagtgaattgatcactgcacctgtttcttacattcagggaacggaaagcagagaaaggccagtggttcacaccactgtttgtgcacccaggtgccctctcaccgtggggagtaaacaccttcggttctgtttgctacggaaaagaaaaatgaaaagagggccaataacaaaatgcccttcaaagaaaacactttgtgagcctgtgtgtagcaaagataagaactaggacactgtcatgagaaagatcctagaatagcttcttgaaagaaagatttctttaaaaaaaaaaaaaaagaatgcgagtgaatgttgctacgacatctattgtgtattatctgccatatccctcttagcaaatgacgattaaagtttctgcatctgtcggtaatgcaaacgggaaagaattcactttcctgaaatttactttaaattttcctttacggagaaatgattcattccccctgtatttcatacctgatatgtaatacagattttatgtttaaaaaaatggctttgtggggctcccatactaaccaaaaatttcttcctagacatttctaactgtatctagagaaaacagggacatcaaaacaaaacaagaacacaacaacacagcaaaatcctggattttcaatttataaagtcatggatgaagaactggtttaaacctaaaatccataatcagagaacttcaaagagatatggtatattatacacatcagccttttccttttgaagaaaagcagagagaagacactggaaggggaaacctcctgctactctgggagctcctaagggctgggaccatatctgccttgtctgcggctgtatctcccacttccagcttgatagctggtatgcaactgcttttgctttcaataaagttatcgagtaaatgattggatacattaatacattgattagttatgaaagacatcaagtaccagagaacatcaaagaaggctaataatgagagtcaagcagtgggtaaccttggtatatacctagataatagagcactggtttctcttttttttttttttttttttttaattttttttttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaacggacatgaactcatcattttttatggctgcatagtattccatggtggatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaagagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcggaaattttctcccatgttgtaggttgcctgttcactctgatggtagtttcttttgctgtgcagaagctcttgagtttaattagatcccatttgtcaattttggcttttgttgccattgcttttgaaaaactttgaaaaaaatttagaagaatgtataactagaataacgaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccaatctagtaaggcaggccaacgttcagattcaggaaatacagagaacgccacaaagatactcctcgagaagagcaactccaagacacataattgtcagattcaccaagttgaaatgaaggaaaaaatgttaagggcagccagagagaaaggtcgagttaccctcaaaggaaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttatagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcgagactaggaagaaactgcatcaactaatgagcaaaatcaccagctaacatcataatgacaggatcaaattcacacataacaatattaactttaaatataaatggactaaattctgcaattaaaagacacagactggcaagttggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatttatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaaggagacctaatagacatctacagaactctccaccccaaatcaacagaatatacatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctatgcaaataaactagaaaatctagaagaaatggatacattcctcgacacatacactctcccaagactaaaccaggaagaagttgaatctctgaatagaccaataacaggctctgaaattgtggcaataatcaatattttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaactcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttaaaaactggcacaagacagggatgccctctctcaccactcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtactaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggacacaaacaaatggaagaatattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatggtttctcttgatagcagcccagtttactgtatgattgttttagccaccttttccccctccaatcttccaagttacagcagttctcctcactaccaaaagtgtgatggtaggactatagtttgccattgtcccttcattcattctacaaatactgagggagatgcagtgatgaacatgacagacactgtcccagtctaatccggggttttctgttataaaagaatgatatcagggtttagattaggtactctgaatgcaaagccctttgaaagttggacaactctgaacacatcagggatcctagtacatgatgaacaagtatctgagagaattttcttaatttaacacctagaaaatcagctaaaagggtaaaactgtttgcacagaaaaccaaaccatttaagaagagattgaatagttattagattcttttgatcaggtagaaaacctatcctgggagttaaaatctcaagataggctcttcttggcctataatatctatttggactagtcacatggcctgaaattaatgagataattgaaaactatcctccactagaatctcctcattttatgcattttatgcaaggttgcttagtggcctaggattgataataataagtaagctaatgaacccaatcccaaactgattttgcagtatcttttatcagtagatttcatggcagttgctgtatatttaattgtaaaaaattcgggactgtttaaactggggaggtgagaaaacagaaggaaaagaggtagaaataagaagcacaagaagattgtgaaccagttttcataaacttagaagcaatgaaaggtacttgaaactgcaaacagaatagagtggacttaaaactgctcactgattgtgtactcaacattttctctgttaaataggatcctagagcagctatttcaaattgccactcaccttaaatctcagactccaacaccttcctcatcactgggcatttagctgcagcttccacttcaataaaaaataaatccaatacaacaatcctacttaacctttcaccaaacttacaaaactaccagtagctatgcccatcctccttcccttctcccctgatgttgtaatagaagctgtactttccttcctatctgaagctaatttctaaatttcatctttctgccttctcaagtacctgtgctattgattatctctaatttctcctgcatcctcaacctctccctctctaccatcttcttctcattgccatttaaacatgtgtaagtcactacccttttaagagtgtgttcttcctgcccctacatccatcttctgctactatggccctttctctcttcccatcgcagccaaaagtcttaaaataattgttttacacttgctcccccactttctcaattctcaatcatgcctgaacgtactgcaatcttggttctttagttaccaccaagtaattactgagttctccataatcaacactgaaatcacttgcataaaggttgtcaataccttccttgttgctaaattaataggatatattttggtcttatctttcatgatgcttttgtagtatttgacacctctaaatgttactttttcttgaaaacctctcttcccttggattctgtgacatcacacgaacctagtctgtctcctatctactgaactgcaaatttccctgtctccactgaaagcttatttttctttatttacccctgaaactttgccattttcctgggttcactcctaggccctcttctcatctacgaactttactctgaaccatttcaaacccttgcaaggttttaattacgtatatactgataattaaatatccaattaaagattctctagcctagaacatttctccataggttcagctcacatacctaggtatcacaacttagttacactatcatcattactcacctggacaatttcaatagtgtgctgaagctatcttcttgcctccagtttgctaagcttcctctagtcccttgaaataacatgacatgactttctcacttccaggcctttatgcatagtattccatctgctgggactccacctcctccaaatccccaacttgacctgtctaactcctgcttctcttcaggtctcagctgaggtaaggcttccttgggaaagccttctgcatcctgccaagccagggtcaattaccttgatgtacacccgtagcactatcatagtaatacccttaccatctataggttgaatatctcatatccaaaatacttgcgactgaaagtatttcaaatttcaggttttggaatatttgcattaccctatggatatcatgcaggcctttagggcattttcaacaatatcttgacaccaccagagaatataccagcaaacacagtgattaatgcacgtaggttttggccccatgctggacattgtagggtacctgccgttgtcgcgtctagcccgcacatgtgccatttttcgtaccttttgtgggtttgcttgtatgatggaatctgggtgtgggtggaaaagatatatcacagctaacgggggctgagaggatctttcttcccttggggatgctgaataaactctatgtggtgtgcctgcattttcactgtgacttgtcacatgaggtcagaagtggagttttccatttgtgatgtcatgtcagcattcaaacagttttggaatttggaacatttggatttcaggtttttggatcagggatgttcaacctgtagtagttacttgtttaatttccttcctcccccactaaactacagatcaaagaagatagagatcaaacctatttcctttatttattgatgtgtctctagtgtctagcctaatgtttggaacatcaataaatattcatgaaagaaatggataaataactgtatgcttgcaccagaagatatcccacagcagtcttttctaatccttggtaatttgaattttttgtattattgatttatatacaagggctaatgtcctgcgaagtagtagtacatatgtttctgtttttaaaagacattgtttcataaaattctattataatgaaaagcatgggctattacatttttccttcatggagatatttcttatatatcgtaaatctagaaatgtgtattaaattagacatactagaagtcaaagaactgaggtacagctatttagaaatgaatttgtggaagcagagggccatgaacagctgtgcaagttgtacaccgagaaaaacaaagaagtaccattcacatcatgagttgtatgtttcacaatctggacggctcttcatggcagtcctgaattgtagtaaaagagaagggttattcgttctcattattttttcctcagactctctcttcatggtgagggatgattattctcgtattcttaaatttcagtctaatagagttattagaattttaaagctggagagtatcttaaacatgaagtagcctagagatgacaaagaggttttacctatgtgctaactctcattagtgagtggtagctacctggagcattgccttgagaagtgctctgatacagagctgactgactagccatgtctttcaggggtaaacgagacagaaacggaagccattcacgtattttccttccttgttccagttaatctattcattttccagaagagaaaattaaggtccagaaaagcaatgcaacttgctcttaacatcagtgctggagcagaacccaggtttctgtacttctagcctacgtcccttccttcacacctggtttcaagattccttaaagataaattataaattctagccctaagatttgctgcctttcaaattttaacctattttcaaggttaactacctgcctttggtcaccagcataaataaatctggatatgccatgtgagaacacagcatcatcacagcaaatagtctttagcatcataaaactatcacataaaatgtagtgccaagtgcactacctaaaaggcacatgttataagtagtaggggtcattgtcaatcaagttaagcaatgcaggggggaaagaaattgtcagaggaacaacgaagagatcatctgtaatatcgttttgagacatatttggcttgaatctatacaaatggcagcagaatacttgcaaggacttttgtcccagtgtgaagaggtaacaactggaattgattcaacgtctattaacattggtcatggtgctagatactgagaatccaccagtaaacaggaaagacatagtccctatctttgtggttggttacattttagtagagaagtgaggcactgaacaatgatgtgagtgttttgaaagaggaagtacaaggaacttcttaggggtgggaggggtagccgatgaccccaaatttttgacaattgccactcggaaacagaatatagagatcaatttgtgataactttctgcagctattctgcatccaggctggatatccaaaacaaacactggattgctggaaaacttaggaatttaatattcacaaatcgatattctaaaataagtaaaaacaattagaaaagacagattcacacagagtaataaccatttgaatctcaatagatactagttataaaatgatacggacctttaaatcagtacatcttctgatgtctaaaagatgcttatcactactcactagactctttttcacttgctttgcaaatcagtttaaacatacatggtaatcaggagtcattatttttattcacttggaaagtcagaagtaccttttcccagtgagattttgaaggaaaagtaaaacacccttcatttggagattttatgggtgtctaaacatgtgcttttctaaacaggaaatgatttatgacttatcaaaggatatgcctgagtctctcacctaatctctaaacccagctgactttctccatttctctaacactgagcgtagcaaaaggagacgctcttgattagccaagagacactgctgctcatacaccaacctatatttgactcagggttggggaattgtgaaacaacctaaatgcagcacttttagatgaaaattgctctgaggattttccattctgaaaagtagaaggaaaccaaggagttcttataataccagaaaacttagaagcccttaatgcacaatattacactgacctacaaaatgaccttcgcacaaagttaacttattaagaagcaaggaaaataggtagaaaggcattgttggtacaaatagaaacgctgctaaaatgccgagtctggaaaatttgaaaaagatcttaatttccaaaactgtttctgctcagaaagaagtaagaggaatatcatttggtgatataaaacttggcccttttgagagtgtgggagaaaatgggtggagaactattgattctgacataatcactgcaaattttctacactgtcattgattaatttcttcaataaacatcgatttaggatctactgtgttctagggctgtgctgctctgtctaacacaggagccactggctgtaggtagctaccgagcaattgaaatcaggctagtgagacggagagactgaagtttaacaaatttttattccattttattaaatttaaatataaatttaaaaattgactcttggttcagttattgaaaaacttttgtgtatgtttggaacaacttaggaatgtgaatcttcttttttcaactataaagtttatgaaatgtaaatagagaccaaatattttcttttttttttattatactttaagttctagggcacatgtgcacaacgtgcgggtttgttacatatgtatacatgtgccatgttggtgtgctgcacccattaactcgtcatttacattaggtatatctcctaacgctatccctcccccctccccccaccccacgacaggccctggtgtgtgatgttccccaccctgtgtccaagtgttctcattgctcaattcccgcctgtgagtaagaacatgtggtgtttggttttctgtccttgtgatagtttgctcagaatgatggtttccagcttcatccacgtccctacaaaggacttgaactcatcctctttatggctgcatagtattccatgatatatatgtgccacattttcttaatccggtctatcattgatggacatttgggttggttccaagtctttgctactgtaaatagtgccgcaataaacatacgtgtgcaggtgagaccaaatattttcaatgaaaatacggtgtccaaattgagatgggatgcaattgaaagacacatgccagatttcaaagacttagaatggaaaaagcaaattttattaatactttttattgattacatattgaaataataatatgttggatatatcagggtcaataaaatattagtttcacttctacttttaaagaacgtggctactagaatacttaagattacataggtggctctcatttctatgggacaacactgttctggacattgtgctggcattgggaacataaaactaaacattcccttaaggattttacggaatggtggtacatttactgctatagcagagagatatagaggaatgcaaaggacgctatggggacatagatgagtagcaattaaattaggctgatgtcaaccatggctacctaaaataaggcatgcttaaattgatccttaaagtttgagtggaagttagatgaagaaagacgaagggtattccaggaagacggaatggcatgtacgataacattgggagaagtagtacaatacagtgattaagaatctagaacctctaccctttgagtcatatgcactcaagctgtaccacttactatctgtgagatcatatgtaaattacttatctgtatctctttccttctctgtgaaatagggatactactactgtcaaccttataaagttatcgtaagaaatgcatgagttaatatactgctcagaactgtgtctggtccacattgtatttcctgctattattgtgaattagaaaatactcccacaggttggagtaaagggaatactgtctgtgaaagtgtcagggaagatggggctacagaggtgaccaggcatcatgcattcaccagagcagtttgaccttttatccttcaagctgtgagaggattagtcacatcttgaaaacatattccaggcataagagtagcagagcatttagatggatctaaggcaatagataagagataagaggccaatgcagcaagctagttgagcagtgctgcggggccactgcgaatagagggcagggcatgaataaggtggatatggttgctaaatgctcttgaaacctttctctgcttctttttaggtatctagctagacttcattttccagcccctctgctgttacatgtggccacagggcagagttctagccagtagaaggttgagtcaaaggacatgggacgcctccgtgtgcagtcctctagctcattcccctttgggctggctgaatatcttcaggagggcaacctcggcaattggctattgcagatggaagacccttgctggcctgttttttttttaatttattttttattttttatttttattttattttattttttttagatagagtcttgctctgtcgccaggctggagtgcagtggcatgatcttgtctcactgcaacctccgcctcccggcttcaagtgattctcctgcttcagcctcccaagtagctgggattacaggtgcccaccaccactcctagctattttttgtatttttagtagagatggggtttcatcatgttggccaggatggtctcgagctcctgacctcaggtgatccgcccaccttggcctcccaaagtgctgggattacaggtgtgagccactgcacctggcctggcctgtattcttgaataattatgtgggtgtcacccctcccttcccacacacacatccaacaccaactaacatgaattcaccttagactgtttacatgagaaagaaatacatttctattttgtttaagtcattttaatagtccatttggtggatgtttaatatattatagctgttagcctatcttagctattatagatatgaaacatacttaaagagctaaaagcatttttacgaggaaaaaaagacttgatgacagataagatatgagagtgatgaagaaagttgtcactaaattctttgagtagcagggcctcaagtgttatcttgagtgcaaatataaacagtgaaccgataagtatgttcttggtgaactcgccaaagtaaattttcagccagcaatgaacaacagtaagaagtaggaatttggtgaggttaaagaaatcaggtatcttcctcaattcagcagaaaagaggtcaagtttcaaaagacattgggaagtgtgggtgaccctcaagaatttagataagaagaggaaaactgtcagagtcatttggttaaggtattgataagattcaagctatgcggctgggtgcggtggctcagcactttgggaggccgaagtgggcggaccacgaggtcaggagttcaagaccagtccggctaacatggtgaaaccccatctctactaaagatacaaaaaatttgccaggcatggtggcatgtgcctgtaatcccagttactcgggaggctgaggcaggagaatcacttgaacttgggaggtggaggttgtagtgagccgagattgtgccattgcactccagcctgggttacagggtgagactccgtctcaaaaaaaaaaaaaaaaaaggattcaagttacgctactccaaaatccacaatatggcagcttggtatttgagaagacagcagaagcaggatggtcactctcaccttccccttcccccttctcccctgaagcaggtcatgagactatcataccagaggtgcccttactatactggaaggaaaggaaaatttttacctctgaaaacacagggacacaggaggttctgcagaaacaggccttgctgtggtcaccccagtttattaccattcccctttgtccagtcatactggacatctacttttcctcaaatcagagcataaaaatacacacttttccctgattctttgggtcatttctgaaggctcctgtgtcatgtgaaacttatattaaataaattcgcatgcttttatgttgttgatttgtccttcattataggtgcctcagccatgaacctagcgatgggtgagaaaagagatcttttctcccctgtaagagtcaagtagattctaaaattctaaacaagcaggtttcgggttctcagaaaacagggggttgacaagaatggttctgacatagcccaaactgtgaaaactgaattatgattccaaggcaatagcatttaatactcatgcttgttgaataggcaagggcttccagaaggaagatcagagcctggtcttttcatctctggaaacctagatgtggtttactcttagaatgaaaaagggctaagtcttcctggggctctaaggactctccctgtgttgaatagaaaaagggataaaccttcaactgggtttgtaaaatatcgttgttccatggaatcaaattcaagaccaaggtcaaaagtgatggtcacatcttgctttctctgaccctacccaggatcagaaccagagccttcagctggcagcccattccttctgctgctgaaaccaatcctcaccagccaggcaattcagcagaagctcactcagggacagcatggaagaggcgtgagatgaatatcgctgctgccattctgttaaccggtgtgagctctagacttcatcatgattactatatttccttctgccttctgggattccttctgacacttgtttcagtttaagaaccatgtttctttctcaaatcattttccttatgctgtttcttcacaggaatgatacacttttctcatcataatttttgaaaatatgttgcaaaaaaatactgtgtgctatctgcagtgattattctttcctttgccttaaaaagaaagtattctagggaaaggatggaaaacaccacagaagttgtgagaatgggcatttgtgatttctaacaaggatttgtcagcctttgactgctctggactttaccagccacagttgctgaagacatgcagggtgaaagatcagcccttacagctctaaatcaatgaactccttaaacctgcccccaaatgtatcaggagctggaccctccactagcaggcagggtctgagatttccttgagcactcactatgtgcgagttactgtcctaaataagtccagtgtagtaattcacttcattctaataacaaccctatgaggtcattaatcttcactgcggatacaaagaaactgaggtatatagaggtgactcagctagaatgtggcagtcaagttacaggaaatttataccattctttacaactgcctttcctgaagtaatggctgtgtataatattgttaagattgggtcgacaaaaatcaaccagtcaaatattagaagcccaagccccgccaacagatggattcctgtattagatgattttcccgagtcttctaacgacaaaaacagcaatggcagcagcattatctgcaaatatttatgagtacttaattgtgttgtgccacataccatattaagtggtttccatgtgttaaatcaatgtaatcccagtatccagtgggcgtcagcagagctgccttgagctgcaacctctttcattagcaaccagcttagatcccttagtcattttggctgggctactctggtggtgattcataccccagggccttgcctgagctgaagctagaacgtggctttgcaccctggaaacctgcctatattttgccagttttctccccttaaggaactgaaacctagctggtacctaagaattgcttctttctaaataaagcctactatggccacaccaccttcccaaactaaggtgctgaccgatgctctcctctccttctaccagattccaacctttagttattcatattttagtcatttcacttaactttacaacttcctcttgcccactgattttggaatagctggtttcctttcttgaagacttgaataccaattaccagggcagccctctagcctcctgtctccagcagttagctgctacagacattatgcttcttgtcagaggcaatgtgggtcatgctttacctctaaacagaatagccccctatctatgacatagaataggaaatgcctgcaggcagggatctggtcttattaatcttcatatctctaacactctttctgttcttagcacatagactattcttaatacgtgaatgaatgaaggaatgaagaatgaatgaacggctattgaaagatatcaatcttcattttcctttcccactgttaaaaatcaaagcgataactcaaatttccaattagaatgaaacataccagttctagttggtattctgacagaaaaaattatactgcaggttatatttttacactaaaattttccatcacgtaactggaattaatttattccaagatagtagaaatgtattggtgcagtatgaaatgaaggggatttaaataacataataaaaagaagaacattacaatctgtttaacataacctaaccctgggaagattaatagctttcaattcatacaaagactgaagtctacaatttcatatacacatggtcttattaaaaatgaaagctggttataatgaaatgctagcaccacgctaagattggcatggtgtatgaaatagacaaactaacagtgtggcaatagttggaggtggaatttcataggataactttttagttccaaaatggtcaaatcacacaatggctggagatataattaagaattaggctctaaaaacaaattctgaaacagaaggtaattaatatatcttcggggaaagctggatttttaatgaatcagacatgaccgcagagaaaggctcgatgttgccctgtactctcttagtctggttagctaaaaccaccccacactagggacctcctagtgcatggggttaaatttcacatttgtgagcagtaagcatgtgtttgctggcactcttgcagcatactgggcatgctgtggaaggatcagagaatttttggaattgtgcactaaatgtctttgttctatacagttttaaataaatgagtcattttcagacttggagtttttctttaaatctgttggtataaaatcctattttctaaatgaaaccatactcaaaagtggaatatatgaaagagataaaagatgaaagtattcaagtgggttagggaaccttggaaagagcccattcaatccctcttcccatctctccctttggcctctgaggcaccttgcagaactttctagaatgacttgaatggtttgcatggtttgaattcgatttgcatggtctgaaagcctccagatctggagcaacactcatacttttcaggtgaggtaactgggatttaagaagttcagggatttttgcaaaatcacaccgacaagtaaatcagttgagagggaaggaaccagagtattttcgtagcaccaggtcttggggcttttgacttcaatttctcattgccctgccccctggaacagtgccactcaatggttcataggttgccagcatgagtgtcatcacctgggagctggttagcaatgcagaatcgcaggccttgccacagacctgctaaatcagaatctctgtggtgggatccagacaactgcattttcataagcttgccaggtcattcttaagcatcctcacccttgaacatctttcccgtctttccttttcttctggtcatgattcctcaactcccaagctcaaaagtagtgaaaatgttgttataaaggaacagaaaaaaaattaggagaggaatagagagtgaaattactccagagcctttattccctcacctcaggtcccactgaagtcattttggaaattatgtagctttttctttttcttttttttttttttttgagacagggtttcaccatattggcaaagctggtctcgaactcctgacctcaagtgatctgccctcctcagcctcccaaagtactgggattacaggctgcgccactgcaccaggcctggaaattaagtatctttgtttaatgatggcattatgaaaaagactaatatgttctgccactcctcttcccggttacttcagctttttttaaatgagtaaactagaaaatcattttttttcaaactaaatgtcttcatgtttatcatgtaacatttgttatgtaaactcattgtttaaatagaaggactagggcgtgcaacatttggccacaaaagaaaatatgcacacacacaaacataactgattttttttaaaaaaaaaacatgtattactttaaaaatatgccagttaaatgttaaaacttatgtatgaatgtgctaaacaaagagactaacacaaaataatttctggtaacatttttagtatcatgaaggcccataaaaatgaggagggtatggattattgaaattgtgtgaaattagaaaactacatagaaacattcccgtgaatgcaaggagacaaagagagcaaatagttaagtacattggacccctccatatctgctcctttaaaaaatgtatatttcagtcatttacattttatgttaaattattatctgactcttctaaaagtttttggtgtaaattaaagatgatctgaattatcagaaaatcaggactgagaacaactaccctgaaaaaaaaaaatggattactttagaatgtgaaagaatggccaaggtctatgcaaagttatttttgctttgaatagaaaccctgagtgcaatgtttaagaatataaacctattcccaacatgcaaaaattctatagaattcttcaaatgaaccctccaagtcagtattttaactctgctactgtgtatgtgctaggtttcccaaatggaattctctattcccagaacaatcttttctaaagccacaaaaaacacaaatagaattcaaagttcttatgcttgatatactttatgccttctttcataaaacacatcacctagttttcacgtttctctgaatatcctatgttgtcacaaaagatatatttctcctaagttaagctaaaacgcatgattttaagacaacctaaatgaaaattgcaaacacaaaacacattcataaattcatgcttatgaaattatgacttacagcataagttattcttgatatttaaaagaatcgtttatgagtttttgtcatcatgaatgtttgacaacaagattatctgtgaacaagagattgtgtgggcttacacagtattttcaactaaaagttacggtattttgtttaacacagaaaccacaccataggttaagtttgagattattttgaaatatctgaactactcagcaggtaaaaacaaataatacagcccatttatagctcatcagttttttgttttgagtcatctaagcaataactcaaggaaggtgagagagagcatttgccaccctccagggtggcaactgaacttcaggaattccctggagatacagccaattgatgcttcacatctctcaccatgctctgccatcaattctccattgccatggaatccacaatggaaatgtgccacacttaggccacttttcatttcagttcttttatatattaccctcccttttcatattctccttggaactgaatgagttactgtttcaaagaatgggggccctgtactagggaagggtggggtataatgacaagcaagttcatttgtttggaataaaatagtcagcaacagaacaataaacacagaagtctgctagaagaggccttcagtttatcaacacaaagagttttcttcatgacttccttggatgtcagttgcatttaaatatagagttgctaataatttcctttcctctttactcgtttaattatgcaatcggatattaaagcattgggtcaggtattttgcccaattttagctattttatttgtattttaactatttccaattttaactgttcttgatttatatccaatttatttccaatttatattggaaatcttggccagtaaataatttgagtatagcatggtttaatattataaaggttatatatacatacacagtctctctctcccatgtaactatatccactaaagtcctaaagtaacaatgcctctgtctgttatggtgactcagtctgggtttcccatacagcagactgaggtgatcctaggaaacactgtagggaacaggaaaggaggagaggaaaaggaagaaacaatccagagttctttattgggctgggcgtggtggctcatgcctgtaatcccaggactttgggaggccaaggcgggcggatcacttgagatcaggagttctagaccagcctggccaaatggtgaaaccccatctctactaaaaatacaaaaattagttgggtgtggtggcgcatgcctgtagtcccagctactcaagaggctgaggcaggagaatcacttgaactcgggaggtggaggttgcagtgagctgagattgtgccactgcactccagccagggtgcagagtgagactccatctcgggaaaaaaaaaaaaaaaagaggtatttattgagtagattactaatctggggaactggggctcaatgctgttggggatgctctgaggatctttggaatatatctcaaaattatcccagtgaggggagagaaagctgagatttgtacccatctactctcccttattggttgagtcttgctcctgttaataccctgtcactttgggcttggtccatgtgcccatctaccaccccaaagctaagaggacatggaaaggatacctgcagcatctgttctacatggtatttgatattaccctcaatatgtgcccacaaaacagtatacaggatcatggactcaaaatgacagcaaaataaacagatgcacacactgttcacaaaggatttgattgggtttgcaaagctccctacatttctttgcatataaactagactcatcccttaaatttcaaagtaaaatctcaccaactgagcgaaagctgtggcacagaagttcctcagagttttaaaagatgtgctttgggtttaattccaaccacatacatataaaaccatgtcagtttcaaagtctaggtcagggctcttaaagctgaaacagctagactcaaatctcagagcattttcataactggatgatctgtactcacttgcatttgcaggcaaaattgtaaatgaggaattacaatatatacattcagaacagagaagaaatttccctaaagacaagtaccaaaaatgttaatgtaaagatttgccacttaagaacaaatggaaaaaaaaatcattggtgcctaactttcgacacataatctaaggtctgaagtctttttgtgtttcacaatatgaaggtgccctggccacaatatttatactattcctagaagattgtaaatagtatctgaatgtgcactgtgagtttctcagattcaaccccaggaacaattgcgcaaatgctctcctgcatatagaaactgctagatcctcttttcagagctgctgctttttgtttttctggagacagggtctcaccctgctgcccaagctggagtgcagtggtgagaccacggctcactgcagcttcgacttcccaagctcaagcaatcctcccacctcagcctcctgagtagttgggattataggtgtgtgccaccacacccagctaagttttttatttttattagagatgaagtcccactagattgctagggttggtcttaatttcctgggctcaagagatcctcccgcctcagcctcccaaagcactgggattacaagtgtgagccaccacacatggcccagagctgcttcttaccaggcagacagagaaatgggaggcagcacgaccttggagaaggaggaaatagtcattgtccccttcttttattagggagtgcaggccccaccatactactattctaccagcacagtgcctgctcctctgggctgctccttccaacctcactgctgccctcagcctcatattcagaacatttcagtggtgaagatcagagcacataatgagcttgtctggaacaaattaagattccgggctttaaagtcaaacagacatgggttacatgggtttgagtctcatttggctctgcgatcttcagcaaatttcttatctatttccttatccgcagaatggagatgataataccaccttcctcaagggacttttgtgatgtatatatagtgctgggtatttagtactgaaaatatgctagaggttgctatttgtagtagtagtagtggtagtagtagtagtatggaaagaaggaagcaagctaccgcacagaagtctcctgaaaatctgaaaaaggcttggggaaatccagcagagagagctttccctttcttcagagcagaggtttttaagttgtgattcaagggccggcaacatcccctgagaacttgttagagatgcaaattctcaggccccatcccagaccaactgacacagaaactctggggatggggcccagccagctacgttttaaaaaggcattcagaagattccattacaggtcaacttttgagaagcactgctctagcggaatagcaggaagggtaaatgctaagctgagcttagttcatatgggacgttaacatttcctctctcattagtggtcccctcctgggcagatctagcatttgagattttcatttacatttcttacttatataccatgcagtcttgggtagggcccgttaaagatggaagtagataactattaggttggtgcaaaagtaattgcgttttttttaccattaaaagcaatggcaaagaccacaattacttttgcaccaacctaacagctgtaagggattatttgttctctgtccaaaaccagaaagactgactagaaagacttttacaggccattttaagtccttgtttgttttaaatatgtacatataaaaatcagtatctatgtctatataagcacttcagtgtgttaacaatcatataatcacgcccatgagagtatcatgtaattgacattgcaccatcattaccattatgttgaaaaggtgagcaatagctactctttaaatctacttagaaatcatacaggattgtgtggtaaattctgtgtattaacataaagtcagatttcaaatcttaaaggcttgtagaataacattttcacagccatatggttaatagttgtaaagaaaagacaatgtttttttactgctgagaaatttgactacagaggactcttaagtattgtccttcatttagaatcttaaacaatatcattacatatgtccttttgattttcaatgaatacatatttacataaaatgtagtcatttctcccacttcttcattgttgaaattgccttcgccaacagctatgcagtgtcaagatgggatcagaatgtgtgggagcagatatttttttcagtcatgctttgctgacatatgcactgttaacgaattaccactgaaacaatatatgtgtctaagaaacatgtagaagagctggctgttaattcttatctatgcgagaagaagagaatatgagagtaagaagaacttggtttgttgagactcaactttggctaaattggaatcattaaagattaaaaacaatgatatctgggttccccacaaaagtctgatatcattggcttggggtacagctggggcatttttttaagcttccaagatgatgctaatgatcattagcgtcatttccttataggtcacctctaacctaaccacttcacagtagttaaatctggctatgatctgtactagctggtatctggttgggagaatcactagtactgggtttttgtatttctgcccagccaggcgttgatcatattttacattaggatttgcataaaagaagcaggccaggcagtggccctatgttcctttccccacacaaggtcatacataaaatatattattattttttattttttccccctctggccttttccctgtaagtatatgttatcactttgatacaaatgaatcataattgaatactcattcactcactccattcacttacttattcattaatgctttcattaaatatttattatgtggtaggtatacggaagtacaaaaaagtacaaaaagacctcacaaagcttaagatctaaacaggaatacaaattcatgggcaattgaaataccatatggcaaagggtaagacaaatgtactgaagtagcacattgaaggtgcaggagatccggtttgggatgttcaggaatctatttatgaggtgctgtctgaaaagggattattaactagctaaacaaaggtgatagaggagagacagattgttcctaggagagggagccatttgatggagggccagaagcaagaaacaaagatattttatttgattgtagagttcagtaaagagggataaggcttgagtggtcacacggagtgagagcatgaagggccatgtaagtagtggaatgctagtaaatgtcaaataactggctctaggggagggcagtggcgctaattgtagcatttgccaatttctgtggtgtaagtgctctcacaatagctgatttcaagcaactaacttgatgtcattgaatgaagaactcagtggaaagagatacacataattggctcttggaatgtgttaattagaagataagtagttagcaagcagagcatgtgtgtactaaacatagatagtgagggatagaaggaccaaaagatacccaatattcatgaggcacctgggtactaaatattcataatatgctaaatacacatgagaccaaatatacaagaggcactaaatattcaagatcaaataaatacacatgagcacttaatgttcacaaggtcttaattcaggcatccataggtgatacctattccagcaccgtaagtcttctgcctgagaattacatggctagtcatcaggctattttggcaagttacagctgtggccatgcattcttgtctctgtgtctctgataaaccacatgccactgaatcaggcaccacccattttggactcccttgttgggaagtcaactttggtccttgtaagcacaccataattgggaaggctgatgcaatacagagacagacaagacatataatgttgtgtactgcagaattcaagtactctaatcttcacagtctgcttacactctattctaagcgtgttaacttagcacatatctttcccgtttgcttctcactgtgattttaataaactctgtgattcaagtattttaatttggtctatgagcctttctgtttcatgatttggataggctgcctggtagtatacttgaaggccatcattgcatttaagtaattccccagatgacagaggaagtttatcataggtgaaattttaaaagatttatgataggtgaagtttaaaaaaaataataataattggccgggcgcagtggctcacgcctgtaatcccagcactttgggaggccgaggtgggtggatcacgaggtcaggagatcgagaccatcctggctaacaaggagaaaccccatctctactaaaaatgcacaaaattagccagacatggtggcaggcgcctgtggtaccagctgctcgggaggctgaggcaggagaatggcgtgaacccaggaggtggagcttgcagtgagccgagatcacaccactgcactctagcctgggtaacagagtgagactctgtatcaaaaaaaaaaaaaaagaaaaaaaaataatagtaacttaaatttttcaagggggaaaaacacctcggagttgatgaagatcattcgttgaatttgcttaatcatttgctacattttaaagaatgaacttgacttcctgtgaagtgaaaaaagcaaaaaaaaaaaaaaaaatcttgaaatggattgacttctgaaatgatttgtgaggccacatccagaaaggaattgagaaaaagtctttaaatatatgatcaaagaaatgttgaattaaaaaaacccaagcatcatattctgatgacacttgctcattttcacacgttcgttccaaaaatattaaaaaacacaagagatgaatcatttgatgacatttaaaacaatgcaaaaataaatttagatctaaagtgtcattgaaagacctaattggattagaaagttaatatttaaataaataatattcagaaacagagaggattatgctctggcctttatttcaatgtatgttatcagtaaatgccactataaaattaaatatgcaatttggagaaatttaatttaagtttgttgggatttatttactgcccatttgtttaaaggcattctgctagatactgcagggggctacgaagatgaaaaatacattctcaggactttacagtctaattacaactatgaagaatgttctccaaagctctaaatacaatttagtacaaataaagtacaaataaaaagctaaagaggtttgaagaaaggagaaacatagctgctgggaggatcgggaacagctcatggttgaggagctgcgggagacagtacttcaataattagggtattggcaggcaaagagcacagagaaagccaagaaggccaaggccattatatgacacggaacttagatgtgatcctataaaaggcaagacagtggctcatgtggcctgtaaactcttttgaataaagaccccaaacttctatgggtaattactatgctagaagcaaactgtctcagtatcctctcaccccaaacatcattattaaactgatcatgaggtttcccagggcaacattggaaacagagtcatctccagtctgggtatacagacttatgcacaactgtctgttttaacaaggaatatgttgtcgtgtgactaatttgcccatttgtctccccaactacactctaggctctagaggccaagggttttatcattttcatccttaaatctagcaattagtacattgtttaacacttagcaagtgctcaattaatgcttattgaatgaaccaacaaatctatcaaacaatagtgcatcaaaatgtttgctccaatctgcttattaataactcagtgtcttggttgccaaaggaggggaaagagaaagggtagagtgtagtagaagagggggaaataagattctaactagcacaatgaacagatttgagttacatatgtacacataaaatcggcatagacgtgatactcacatacaaatacagattggaaaaaaaaaaaaccccactgggctacgaggagtggagttgccaccattccctgctatatatcccctctagctggccttaggtgacttctcctctctttcaaggctcctttagacattctagaatgaaaatattgcagaattggaatgagagaggcatactgtttgatttactctcttagataaagcctgaataatttcgcttataacaatgacagaaattattggaagataacaaagtgtcatgtgaattatctaagaaagataacattagggtggaatgaagagctctgaagagtgccaatatatgaataatacacattatatggagaaagccttttcttttttggtgaatacatgattgagtagaattttacgttgctggaaggtagagtttgttcttctctctatgcatatatacatggaactagtctccacctgagagcttatgacctctttctctctctttggtgttgaatatgtgtgtatatgtgtgatactgcagtgcttctcaagctgcaacgtgcgtgcagatcccttggggattgtcttacaatggcggattctgattcaacagttctgaagtggggcctgggatttcaaaattctaaaaaaactcccaagagatgttgaggcttcaatcacactttgcacagcaaggtgatgctcttttaagaaactgaagcaattactaacaaataggtcacataagtatgtaattataacagaagtgaatctgtgcacaaaagaaagaactatgaaagaattatgtctgagttatatgtgtatatatatatactatatatatgtgtgcgtatatatatatatggacatataattggcattattattactgtgatagaaagacctctcttctgcaagccaaattatctttcactttgttgcttcttgaattcttttcttcttttttcccctacaattgcatctccagatctccttgaaagggtcaagtagaatgcctatgggctatctaactatgttggtaaggagtttgaattcaatgacattcaatgcatatctaagccaagctgtcacaacacactcaagcctgccaaaggagttcgtacaaatctttaaaataatttacaggagagacaaaattaccacatcattcccattatcagaagaaataattcaaattaagaaaaattagaaataaaaatgaagagatgacactgaagaatatctcaccactggaagatgactttcatctacagtgatctctctataaagcaaagatacttttcagctattattcagtaagtgagtccaacagtttcctctgatattgtgaatttaattagtaggcaatttgctcatgaaatcagaatctagcccttcccttgctgggttgctggatctgtgtattcctatattcttctctagctattgcctcatttctcaaattcctttcatgtcttcatctccattccttatttccacctccctacttctcaactcaccaccataagacttcttggctgccgggcgcggtggctcacgcctgtaatcccagcactttgggaggccgagacgggcggatcacgaggtcaggagatcgagaccatcctggctaacacggtgaaaccccgtctctactaaaaatacaaaaattagctgggcatggtggcgcgcgcctgtagtcccagctacacgggaggctgaggcaggagaatggcgtgaacccgggaggcggagcttgcagtgagtcgagatcgcgccactgcactccagcctgggcgacagagcgaaactccgtctcaaaaaaaaaaaaaaaaaaaaaaaaagacttcttggctctggttccagtgtaaattctttgattgcatcatcatgaacctcttacttgaggttagggctcagcgccccgaaccctcacactgtttgagggtcaactgtataacactttccctaattcccaactcaccacaataagacttcttggctctggttccactgtaaattctttgaggcatcatcatgaacctcttacttgctgaaaactccaagaaatagtgttcacacctagctttttcagctgcctggtagtccctgacactgccagccacttccttgtctttgagactttctccttgctcaggttcctagtcattcttctcctttgtagcctgccattttctggccacctgcttagctcctacaggaaacacttcataagtgttgttttctgttagatatcctgcctgagaaatcacacccctactcttgcataagtgggaaattcttcaaatcttaggtgaggaatgttagatggcttctcttctctttcaaggcttgtgcatgcagatcttttggggatcttcttacaatgcagattctgattcaacagttttgaagtggggcctgggatttcaaaatgccaacaaacccccaagttatgtcaaggcttcaatcacactgtatagcaaggttgacactgtctttaaagaatgatgcaattactaataggacacataaatctctaattattacagaactgaatctatgatcactaaaaaaggaaccatgaaagaaaagacattatgtctgagttatcataccttggctaaggtagtaccaagataagctcttcacaaagctgaatgggcttcacaatgatcagggtggtagaattcagtgggcccacaaactcctttgcaacttatattacggatagggacatttcaaaatagacactcgaacagacagtgccgtgatctgtaagggttcaccaatatgtgcacacttaaaacttatacccattggctgggcccagcatttagattggcagcaagaccaacccctcctctccctccacctcctcagcctacttaacgtgaagataatgagaatgaagacctatatgatgatccacttccacttaattaatagtaaatatatttttctcttccttatgattttcttagtaacatcgtattttctctaacttactttattgcaagaatacagtatatattacatataacaatgcaaagtatacgctaatcactctttatgttatcagtatggcttctgtcaacagtagcctattagtagttacgttttgggggagtgaaaagttctacttagatttttcaatgtgttgggctcagcgcccctaaccctcacattgtttgagggtcaactgtataacactttccaaaggctccctttgccctgttcttagacacggcccagcatgaatttgtggcaatcttgtaatgagccacatactgtctaacaagttggatgctaattatacaaaacttttgaaaaaagggatcaaagttcctacttcacaagcttgaacagctgtagcctcaggaactttctccagattgagggcaaaaatcctatctccaggaagccaaatttgcagctgccacactctcccaaaatcccagttcacctcagggactgatggggagtcagtcatcatacttccttcccctttgggctgaaactgaaaaagcaaaaaacggggtgggagggtagaaagaacaggaagggaggtatcctgttcattggagaggtcctaaggaaacctggctggagtgaaaatctgctgtgccttaagcaccacccttccatccccaggccaatacacatcatattactctgttgtcctccttcaacagtgctagttacagactcaagtttaccattagtatataatagctataacacttgtccttaaaatgcgggttaactcaatgctgctgggcatcaatctaaatatattaaggtaggcactactgtactacaactctaataataataatcaataactatcatttattgaatggccacatggcaggtactatgcttatcagggcttccctgtctgctcagcccatgtttctttgtaaaacacaacatattaaaacaacagtatttggagacaaaaatatcttcaatccaaccacctcataataaaaccaacatattcagttttctatattatcttatcgtccttgtccatatacatattcaatggttatatatttgcagtaatatttatattccaccttttcactttttgtgaaacttgatacattatttgttcctctttcattctcctttgaaaatccaaggtaacaaatactgataacctagtatatatctctccattcctccttcatggttatgtaatcccataagattaattttatcttttttattttaaaaatggaatatgttaattgaaacttgttttgatttttgaaagatatcatcaccattctttcaggacagtagacacagctctaactagactaaataataattcattctgggatgcccaaataattccataacatattcaataatttccacactgaagggtatttgcttgatttctactttttgaccatcatagacaatgccaaaatacacatcctctacatacagcctttcatactggtacttttatttctgtagtattgattctcagaaatggagtgactgatcaaaaggtaagtgcatttaaaatttttgtagatcataccacatttctttcctcaaagaccacagcaatttgcgtttcatctgcaatatctgagagtgctctcttccattaaaaattatcattcttaatttctgtctatttgttagatagacatggtgtcttatttctttattttcctatcccttactactatgaggaagcatattatcatagttttatttttccagctatctggatatcctcttctgggaattgcatattcctatacttcggccagttttgtactgggttgtttgaattttaaaaaatattaatttaattaacaaatttgtaggagaaatttgtatattaggtatatgcatctctttatgtcacatgttgcgaatacatctactctatttgctgtttttcttttgactttgtcttctgttattttaagcagtaacaaggtatattttttccttatagcttttgagttttgtgtcttgtttagaaaacgtcttcctcattccaagaatttttgtttttacatttaaaactttaatgcatttgaaatgtattcttacattgcataagctaggaggcaatctgtgttttctaagaggaattgcaaagagtgctggcaccatttattgaataaaacacctttattccttgaattaaaataacacatttgccatataatgtttccaaaaacaatttgtatctatttatttatttatttatttattttttgagatggagtttcgctcttgttgcccaggctggagtacaatggtgcgatcttggctcactgcaacctccgcctcctgggttcaagcgattctcctgcctcagcctcccaagtagctgggactacaggcgcccaccaccacgcccagctaatttttgtatttttagtagagacggggtttcaccaagttggctaggctggtcttgaactcctcaggtaatccacccacctcagactcccaaagtgctgggattacaggcgtaagccaccatgcccggcctccaaaaacaatctgatctgcttctggactctcaattttgcttcagtgatctacttgtcttgttttgtgctaatactatactatttggattacagtagctttacagcaagtttaatattggataaggcaagccccctcccttattattgatgcagagacatttattatttttcatgcattcctgagatacttgcgattatttattatttcatatgaactttaaaagtctcccctcctcaatatatcttgccttcaaggcacttgaaatttacagggaatttaaattccaagatttaaataaaatcttgataagcctaaaatactataaatctattctatgaaacagacaccaatattaaggcaaaacaatgaaagtgaaaaccaataaaatgttcagagcactgcttaaatagattatgatacatccacaaaatggaacaatatgtagtcattaaactaacggttaagttctttgctatgggttgaattctgtccaaattttctccaaatttaaatgttgaagtcctaacccctggtacctcagaatgtgaccctatttggagatagggtcattacagagataatcaacttaaaatgaggtcatttggttgggcctgagtccaatatgactctgtccttaaaaggggaagttggagacagacacgtacacagggggcatgccatgtgaaaatgaaggcagacatctacaggacaaggagcaccaaagattgccaacaaaccatcagaaactaggggaatggaatggaacagattctccttccgagccctcagaaggaaccaaccctcctgacaccttgatctcagacttctatcctccagaactgtaagacaacagacttcttttggttaagtcatccagtttgtggtatttcactattgcagtcataggaaacaaatacattctttatgtactgatacaggaaaatgtccaagaaacattgttgagagagaagcataattcagaagaaaatgtgtatcgtatgctaccattaatgtaaagatgcatatatatagaaaacagacacacacatatacataacataaacttatgcatattcgcttgaaattcgtacatatctcctgaaggatatacaaacagctgacaatactgattggtggtgggtaggggaattgattcgacagtgcatagaggtaggagaaataatttttattttatacctttttgtaaattttcatttttgaatcatcaaaatgatcacctagtggaaaataagtaaaattaaaaacaatcaaataagaccccctaaattatcagctttctttttactatcttaattaaatcagataacttgaacagatcttcttttgtactttctgtgtggaaagttatatcagactgaaacatgttaatacaaagtatttgcatatagacatagacctctatctttcccatttactcagacaacaacttttacaatgttaacatgtgttcaacattgcttgaagtaatatgggagttaaaagaatacaagacatactttctgtattacagaagctcttaactgagtgatggagaaaagaaaaaaagacttaggtgaagcatgaaagtaagtcacttcagtttctttgtgcctgttttctcaacagtaaaataacaaatgagataaatgactgttgaagtcttaaaatttctgaattgttttatttgttttttgaaattacacttttagttttgagataattgtatgttcacatgtagttgtgagaaataatacagagaaaaccagtatacccctgaccccgtctccctgaaggtaaaaccttgcaaaaatatagtacaatatcataaccaggatattgacattgacacaatcaaggtaaagaacagttccaacactacaaggatgcctcctgtgttgcccttttggagtcacatccatctctctctctctctttcccctgttgtcccggactccttgcaatcaccaatctgttcttcattctttaattctgtcacttcaagacggctatataaacagaatcattcattatgtaaccttttcagatgagctgtttttactcagcataattctgtggagattgatctaaaagttgttgcatgtataaatatttcattccattttattgctgaatagtattgcctggtatgtatggatgtaccgtagtttgtacaaccattcattgttgaccgtctgggttctttccagtttttggctataatgaataatggtggtatgaatatttttgtacaggttgtaagataaatgtccaagagtgcaattgctgggttgtatggtagctgcatgtttagttttacagaaaattgataaacagtttgctacagtggctgtaccattttacatttccaccagcaatatgtgaatgatccattttctccacatccttgctagcatctggtgttgtaactactttgttttagccattctgatagatgtgtaggaatatataataattttaatttgcatttctctaatggctaatgtttttgataatcttttcatgcacctatttgctatctgtatatcctttttggtgaaacgtttcttgatgtgtcttgcccatttcctaattgcattgtttgtttcttgttttaccttgcagttttgagagttctttatatattctagacatccatcttttggctatatggcttgaaaatattttctatcagtctgtagcttgtcttttcatcctccctcacaggtcttttgcagtgcaaaggttttaaatcttgatgcagtccaactgatttttttctgtgtgtggatcatgctttcaatgccaattctagccctagagcctgaagattttctcatttttccctaaattttgatagttttatgttttacatttaagtccatgatctattttgaattaagtttttacaaggtgtgagatttaggttgaagttctttttttttcccactctagggatgtccaatttctgcaggaccatttgttgaaaaggtgagctttctctattgaattgcttttgcaactttatcaaaaatctgttgggcacatttgcatgggtctgtttttgggttctctattctgtttcatttggtctatgagtctatccctccagcaacatcatactgtattgatagccttactatattgttagccataatattgggtagagaggttactcccactttatttacctttttaaaagactgttttagttattctgtggcctgtgacttttcttatagattttagagtatgcttgtctatgtgtacagaaatccttgataagattttgatagaaactaaattaaacctttagattgatttgagaagaactgacatatttgctatgctgactcttccagtctataaacatgccatataatccacttatttaggttgtttttaatgcctttcatcagcattttataattttctacataccgatcctgtacatgtatgatagatttatacctacgtatttcatttttggataagcaattataaatggtgttgtgtttttaatttcacttttcacatcttcatttccaacatagataatccgtaagttgtgatggcttgccttatgattttttgactttatgatgggtttatctaaatgtaagcccatcataagatgaggagcatctgtatataaaaatgtgactagctttggtgtgttgatcttgtatttttggatcttgttaacctctcttctcagctccatgagcatttttggttatttttgcttttgtttttgtagaatatttgatattttctacgtacacagtcatgccatccacaaatagaaataattttattttatacttttcaatatgcatgctttattgtttttccttgctttattgtagtgtctggaacttccagaactatgttaaaaaagagtagtgaaattgggcatccttccctaattagcaatcatgggtggaaacattaagccttccattattaaaattatgctattaactgtagttttctgtagataccctttattaagatgtggaagttatcctctattcccagttttctcatagtttttatcatgaatggatgctgggtgttgtcagatgcttctgcatcaatcaatataatcatatgattttttcttctttagtttgttgatatggtagattacactaattaactttcaaatgttgagccagccttcaatactaaatcccagttagttatggtatgacactctttttttaaactttgacgcatgttatttaatattttgttgatggtttttgtctctaggctcatttatttattttagacctttcctgtcttctaactaaataatctaatgctatacattttattctcaatactgcttttatgacatctcactttatttttttttgccagagaaaaagactagattactcacagcaaagcagtagtcaaagaaccaacattttattgagccagttcccacagagtaatcccaaagaagttcaggagacacctgtacacacagtggattgcatcacaggagagaaaccctgagcttaaggaagcttaatctttaaaaatagacagtagatatgcttgccctttgcttcagaatctcactcatgttgatgttttattttcattttatttagttctttgtgtttaaaaaatttttctttgcaacctcctccttgacctggggaaaatgatttaaaggtgtgctgcttcatttccaagtgttttgaggtttttcttttgtctttctcttattgatttctagcttggtttcattatgttctgggaacatataagttgaattctctaaatttgctgaagttgcttggagtccagaatatggcttatatcagtgaatgtttcatgagagctttaaagtaatgtgtattctgctactgttgggaggagtgcttcaattagatcctattggttgatggtgttgttcagttctctttacccttgcttattttccatttagtagttctatcaactgaagagagaggagtgttgaagtccctaactagaaatatggatttgtctgtttcttttttcagctctattcatttttgcttcatgtatttggaagctctgttgttaggtgcaaacacatttaggattattatgtcttcccagtgaattaacacttaatctttatgtaatgtccctgtttgtcactagtaattttctttgcaatgaagcctactttatctgatattaacattactgctgctgctttcttttgattaattgttgcataatgtaactttttcgattcttttaattttaacctacctaggttgtatttgaaataaacttcttttagacggcatattgtgtgctcagcttttatcaatccactcagctaaatctcttttaattggtatatttagaccatttgcatttaaggtaattatggatatattagggcttcaatctgccaccttatttggtttctgtttgttttctttatttctcattcttctctttcttttttcttaccttcttgtgggttatttgaacatttcttaagattccatcaaaatttatttgttgtattttcttaacgtatcactttgtatagttttttagtggtctttccaggcattacgatacgcattaacattgcaatctactggaattgacttcaggtgacgtgtagaaggactcttacttccacttaggtatgtcttcttttaaaatataactcttaagtattttctctacatacattgagaaccacatcaggtggtgttaaagttttcacttcaaacttatggtaaataggatagtctattattttactctcatttttacccattctactattttctttctgaaatgtcaagacttcgttataatttcctttctgtttagagaatgtctttttgtcattctttaagagcagatttgctagcaagaaattctttgttttccttaatctgagaatgtctctttccctttaattccttaggaaaaccttaggagttatctgattatctaagagtctgtaccttagactttggttatgctattttgcaattctgtacgtttaaaagtcaatttgtggagggctgatggtgacacaaatgattcttgttcactagatgccagtaaaattttctcatggaacgcaatagattcctgccctacagttagtgatcagtattgtatctgttataaaattcctatcagcattctagagtgttttttatatatatatgtgtatatatataaaatatatatatacacatatatgtatatacgtatatatacgtatatacgtatatatatgtatatacgtatatatacgtatatatacgtatatatatatgccaattcttcagactctcctttgaaccaactgtaactaacatcttactaattccttcatcagttaatgatctaataaaatgttttacacatattcattttatatttttatgggactcacaattttgtctctttagaaatgtagccttatataaaatacagacataaaatgacccattaattcattattttacttacaaaaggtacctatgtatctgaaagttttctaagtgcctgacacacagcttcccctaatgataactcttctgtacgcatgagagatttatctaaacatttaaacaaacactgatacaacactattaacaaaactacagactttattcagatttcaccagtttttccactcatgtcatttttctgtttcaggatccaatccagaatctcctactgcatttggtccttgggtctttttggtctcctctagtctgtgacagtctctcagtttcttcttgttcttcatgaccttgaaacttttgaataggactagtcaggtatattctagaagtctcttaagatttgactgaagtattttccctattagaagaagttacaggttttggggaagaataccagagagataacatgtccttttcatgacatcatatcacaggagacatgatatcaatattattatcactggcgatgttatacttgactacttagttaacttggtgcctgcctggtttcttctccattgttattcctacttttccatattctattatctggaagtaagttaccaagttcatggaggggcttaggggaggattaaactctacatcccaggaaaggagtatctatgtatattattaagaattgttctataagggaaaattttctctcaaatatgcttttttactaaacagagaaaacacattattatctgagtggttgctatatggctaatctcatttaccttcttttgtcaattcataaactggtcttttttcccttttcgggccagtataacttaataggattgtttatcttatgttattaatttatttgtagatgacaaagattccttttggtaggttctggcactcaagactaataggtttttccatatatttctatggatacaaattgtaccagcatgctgggaaggaaaatgagctgacagtatatgtgtcactttgaatcactgggtatcctacagggaatatcgagttacttaagcttcaaagaaagatgtgacaatggttaaccataatttagatttggattttaatattctcacagcctggctggcccatcaattttttatgatgtttttctcttaagtttctcaacaatttctctgggcaagtttgtttcaaatgcaagactaattttaagcttgattaaaatgttaaacagactcatgccatttgtattatcctttatgaaaaaatcaatactttaatagactttcttaggaaactattttgagaaactcaatagcattgttaaataaagtagaatgtcccatcagattccagtattttatatgtattctctgacaaaagggtaaaataagaagcaatgagttacatgataaaagatttaaaggggtgtgtgtgtgtgtgtgtgtgtgtgtgtgtgtgtgtgtgtatagaaaacagcttttaaacattacagtattctgagctaagggtggaaattcacctcagagaatttttaattgtctgtctgagtcctgatgcctcaaatttagcatgttattaatcttctaacattaccatgttctattgcaatatttttaaaatattgtaatttttaaaaatctgtctccgctactagattgtgagctctgacttcaaagactatatcttatttctacttctttcctcggtatggaacatcacacctggtgtacagtcacactagctatatttcaattgctcagtagccatatgctacagtactgcacatcacggatataaaatatcttcatcatcgcagagaattcacatcacagtcctgatttagagcaggatgtctgaaacttggcactactgacatattggaccaaataattctttgttgtggggggctgtcttgtgcattacaacatgttgagcagcatccctggcctctgcccacttgatgacagcagtatccccgcccccaatgtgacaaccaagaatttcttgagatactgtcaaatgttctctggggatgaaattatatcaggttaagaactactgacttagataaatactccctgaactagagtcctggaaacctttaggtggccaagacttattctaaagaattgctaaaaattattttcttttaaaagagatgccgggaggagagagaggagcagaaaagataactactgagtagttggcttaatacctcggtggtgaaataaaatgtaaaacggacccctgtgacaccggtttgcctatgtaataaaccttcacatgtaccccacaaacctaaaataaaagttaaaaaaatgaaaagaataggaatagattaaaaaataaaaataaaagtgatttcacatataacaaatgtttcctatcattgcataaggcaatgctgcttaataaaagaaaaatttagtatagtagaatcgtgccgcagtcatgagaagcaacccttccccatttctcttaaccaacacaccttgaatccatcaaattaaattcttgcataagaggtaaccaccttcagatttctttcttagacctgtatctctaaaagaaaacatccttaccactttagtgcagactggcctggctttcaactatgaggatccacattttttttccctaatggctttagacatactctggacacaaaataatttttcttgccaaggtggtatgccagaaatgctaggaaaataattcccccgttggaagcagtcctaaaccaatgactagcaggattttgtgtataaataccccagctcccttgcccctttgaaagaataactaactcttaaacacatgtcttcaatccatttagaatttccccagtgggattaaactccactagaccagtggcagttggcttgataatgcattttttactgaatgatttctcttcacagtctcactatcttacctcacattcatctctgccttctgcagtagctggtgcttcacatttctaggacttcccaagttctaagtacttggaattcaggtttccaagatatgctaactcctccattctctgcatattcctaaattttttatcttttttattttattgtttttcctcccagatttttttctctttgtggtaaatatcattttaattcccctattctcattttagtgaaggttaaagagacatcatttttaaccagaactccctataagtgatctatggaaagaaaaaattagcaagaaaaagacatttgactagttgcatgagtcaagggttaagtaaaggagaggatgaaatttgtgataatttaaatttagctagtgggaggttgcaaacaaagactcctctctctgtaagctagaattctttatagccttaaatttcccaggtctagtttagtatttatatttattttcctcactacttttttactgcaaaatattcggaaaccatttgtaactttaagtcacacaattctaatttaatgattaggttaaagcaacaaaatttcctactaattttgtagctctataacactcagatattggcaatcctatatggctcaaactaatactttaacatattgtttatggacatactagaaattgtactgtgtatgctaacttctacactgggatctagattttgtacctctggatcttttctaagctgaataaatatgttcatacaaggttgtactctggttaacattctgtttatcaaaagacatgataatcatgtatatgaaacatgagaaaatttgaatcagttaaactgaaagatctacttagaaaaacatctacttcttctccgagtcacattcttgtgaattctggctttttaaaattatttttgaaattttagtaagattacataaaacagcgccatgtaaactataaaggatcatatacaaatgaagcacattactattagtaattataatgcaccaccagaaataagagatagaaggccctttaacctattttgactatgagacaggaggatagaaccaattcccccaacagccagggttcagtattattaataatgataataaaatgaatctactaacaacataccaagccttcacaatatgcagggcaccgtactaagtgctttatataagttttctcatttaatcttcacaatattaatctctactcctattcctctatttagaaaccagacctggagtgattgagaaacttgaaggaaaatcacacagtttgaaagtgacatagctagtgttcagaaacagagtctacactttcattactatcctccactgcaggataattccagtgcaaaggatgatctgtttgtttttttttttgtttttttttttttttgaggcagagtctggctctgttgcccgggctggagtgcagtgactcgatctcggctcaccgcaagctccacctcccggattcatgccatcctcctgcctcagcctcctgagtagctgggaccacaggcgcccaccacaacacccggctgattttttgtattttcagtagagatggggtttcaccatgttagccaggatggtctcgatctcctgacctcgtgatccgcctgcctcggcctcccaaagtgctgggattacaggtgtgagccactgtgcccggctgcaaaggattatctttaagttaaacatagaaataaggatgtaaaatggaatttagaattctgaagtctatcaacaaggaaactagtgctatgaaaagctaggtaatttgtccacaaatacccagtgctacctgcggacagagctagaaaagtgcccatatggtcatttacttcaccaccaaagtgaaatgcaccaaaccaaggggaaatgacttctctgggagtttaacaactctacttttttttccctcatttaattataacatggtctgttaacttgcaaccctctatttgatgtctcttcttttttcagtctttagcaaattccacatcgtatttggccaaatcagacataaaattaacatcaattcattctcaagagacaaaataaaactacgattttctaatcgtagttacttttctcctaatcttttgcaaatgtcaccttctctatgaaaatgctatgttcaaatgacctgtgtaatatttcatggctctaatgcaatcacaaaatatatattcggtatcaagatatataagatacatgttaataagtccctctaaagttgtcaaatttacactatcagaatgaaagattcctgagggctaaataaattttgtctctacctttcctcctcttttacaatgcctggtcttgttgtataaacacggtgtttcagtatcttcttgatgataatgaggtggatttggccaatctagctatttaaaaagtctgctctgttcttttaacttagttttgtagatgtataacaaaactagttatggaaattctctgagatttagataaatcattttttcacataaaattggtgctacagaaataatatgtggactataagctttcactattattgaacatttggccatatctatgaactattgagacagttgaaaaaaaagccacagctggaactatatcgagctcaactctgcaacttaattgtgaaataaatacaataataataattgtaacagcaggacctaaatcatgctggtgtaactgctgggtttgtcctcagatattaactctaaaggttatattcattgtggtgccacctgtttggaaagaagggcacatcaggattttgagtacatattttagagttttcctttggtactgtaccatataatatggaacactaaaatcacaataaaatgtgtctgctttgtgtgaaggtaagtaagtgccaagcttattgtaaggcatttcaaatcttggacacaacgccttttatatttcaactaatatactgggctgttgggctgtgctcatttttataattacagtagtttcctacataaacagttttaaatggacccactgcaacatgccaagaaataattagctcctatcatttaatcttatatatttatatgtatcatagcatatgttggcacataacattcacttactaattcaagcatcatcaagtaagtctagatcagaaatatatttagcagttccacctctacatactctttcagactgagctaattagccactagttacagagaaaaagataatactttctaaaatatatatttagatattttctaaaataactttactttgaaatggtttaagaccacaaaacttgcaaatatagtacagagacttctcacgcaccttttacccagcttctcccaatgatagcattttaaatacccatagtacattatcatcaaagctaggaaactgacattggcacaatactattaactcaaatacagacctcatttatatttcaccagttcttacatacatccttctaaataaatatttattttaatctggcttaaatcctaagtcttatggtaggcaagtatgttttatagcggttttaatatcattcaaaattttctaaataatgttcagtgtagtaaaattataagaatgatattctgatcacttaattcaaaactctttgctttctgctatgggactgttgccacagaaaatttcaaaaattacttttttttttttttaaagacagaaagcatcttgaatgagagggcctgactttgtatccctgttaatatgtacgttctcaattactccatagaaaccatatatgaaaagtttagttctgcttctttgctcccaagtctcatttcttactagcatttttcttaacatctggttcaatgttcacagcagatcagctttcaaatacttttttttaaaacccagaaattagtcaattttacatttacaattataggtcctttaggatattctaacaagtaaaaatcctaaaggcaaaatgtatgttttcaagtaaaaatatatgaggttgtttttttttgacagagtctcactctgtcacccaggctggagtgcagtggtgcaatcttggctcactgcaagctctgcctcctgagtagtgggactacaggcgcccaccaccacgcccggctaattttttgtgtttttagtagagacagggtttcaccgtgttagccaggatggtgtcgatctcctgacctcgtgatccgcccgcctcggcctcccaaagtgctgggattacaggcgtgagccaccgcgcccggccgatgagttattatatatagtgcttcatattatccatcactgttcctatgctagaagtcactcacaaaagctaaagagttggcatagctatttagcaaatataaacaaatatctgcttcctaaatattttaaagggttagtcattattaatttttacaaaatgtattgcaatcacattaatcgcaaccatataatatctttgtaatgtggatataagttattcaataggcattcgttgtgatattactttaattaatacttgttttttgtaaagtattacccgccttttgatggcatgtccttaatgactacccctcttttggtgagtgccagatcactattaattccttttgtattcattataacaacatcaatcagggaaagctcatttgctattaatgtgaatataacaggtaattccattctaatctagtagtgattaatgttcacttggtagtaattacaatatcacatttcagagtgttagcactggacaatacttattttgtgtggccttttaaagaaccacagcagcttgtctggacttagaattgaaaaggttaaagaaaggcaattaatctaaggacaaagagaaaggattcttatgtggctgggaaaggtgaataatggttaagtgaagggtttacaaaatttgttactattttttggtcaatcagtatgcttcatatgtacccagtaatatcactacttgacttgtaaaacaaagaaaactgaaatcgacatgtttaaaaagccactgttttagctccatgatgccaatgaattttcaaactacatggattccctgtcctaaatgacagattactatcaatgtgagagttacaacttatctttaaaagaaggggcccttttgatgttatcattttatttgtaaattagtaaaaattaaatgttctacctaattttgaaccaaaattgcctttatattgaaaaaaatcacctaaaacacatcgatgatatatattaatattatagctttattctattttaggtaaactatacaaacttccattaacatcaaccagagagactcccacacatattgacacaatatgttatgttagatcagagcagtgctagtcattgagttttaaaatcctggaaatattaaacttactggagaacattataggttatctgtaggcatcagagatttataggctatatggggtggaaaatgcatgtgaacctcaaaacaaccttgaagtataggcaagacaggtgtcattaatcttatttcacagatgcggagattgatgctgagagaagttaagagacttgccctaaatcccactacagagcatttactggaacccagggcttttaacttattttcttggtctttccactgcagcccatgccatcctgcctccactcacttgtgacagcctgtagagaacagatgtaagaaaaattgccaagagtttaggagtatccaaataacaaaaactatcagactattagggtggccaggggagaaagagaagagaggaaatcaggaaggctgggatttttcaaaccatttgggcacaccccaggtttattcctgacatattgaataccaagtctgtaagtcacagaattcaaattacaaagaccatcagaaagcaagatttttgatgcgctaccagagccacttagactaattcagaaactaagatgaggctggcctataaatgaagcttattggtagatacaactggtactccagggcagcaaagggaagataaataaatctgtgcaatgcgtcaccttggaaaagtcaattgctatttatttaacttcatttcaaccaacaattattattaacaacaaccacgtatcttgttgaaaattatgaatagaatgattaacaggacaaaatcattgccttcaataagttcacagctgataaaggctctaaaacagggctttccaatgggtatgctaaggcacatgccctgattgggttataggtacttcagatatcgatccctctcagccctgggatggttaggcagcttagagtcttcggccagcttacctgatatcatgatgaacacatcaacttaatctgttcatcatgatatcaaaaagactgaggaacactgcagagaagtttgggctttcttacagaacagactgactgtatagcttagctgagggagatctggagaccagaagatgtttccaagaagtgtgataaatctcagcttaagccagaagacaggtgagagtctttgtgaacatttcagccagtttaatgagcaatccaacaacattaagacatgtcaagattagcaagcttcagattgtgtgataaaagtgcaaagagttcgctagagccatactgaataatttgtctttctcttctacctttgtctgccaacaattctacccattggccaaatgcttctttctctaataaattcttgttcttgcacaatcacttgctcctttgaaccacctaaatcgctgtttcccaaaatgtggtttgctgaacagtagtggtagggagccaatttaccatgttacacagataaacagcttatagtttaaattttaatattcatttagttttatctgtattaaggaaaaaaacactgcaacatcagactacagttttgtgggaattatcacttaaggctaaaagcagaaaacaaaatgagctgattttaagaaaaacattaagtaaataatagtatatgtgttattcaaaagattgaacaatggagcgtatatttgtttcctattgcttctgtgacaattttccataaacttactggcctaaaacaacacaaattgattatcttatagttttggaagtcagaagtttgaaatgggtttcatggattaaaatgaaagtgttggcagggctatactccttctgaagaagcttagaggacaatctatttccctgccttttccagcattagatgctaccaacattgtttggctaatggcccctttctctatcttcaaagccagcaggggctatcttcatctctctgactcccactctcctgcttccattttcacttatatgaaccctgtggttagattaggcccatctgaatagtccataaaatctccccatctcaaagtcacctgcttagcaaccttaattccgtctggaatattaattccctactgccagggagcacagcatattcacaggttctggggattaacatcttcgaggggcccatgattctgcctaccacagggggaaataaaacttgctttagccaatcggatattgcaggcttaatggaagcaggggctcaacaaattgtttacatgtttgcacttccactcttcacctcagccttcacaaaaaggacttgctcgggctggttagcctgctggagggatgttcaagatgtgagcgatagagctgtgttgacccagccactttcagacacttaagctctcagctaccctccagattcccaagggagcccagtcagagcagataaactacccaatgtaaaccatcagcccacaaattagtgaactcaagaagtacctactgttttaagctactgagttttgaggcggtttggtaatggactgatatactattatatataactgatacagacataaaatgatacttttgccaggtaaactattaaaacaaaacaagatttaccatccactgttaccatcatattgttaaggaaggggtatttcaaccacaagaaataatcagaaagacatagtctcagcctaaatggtaggctgtcctaagaaaggaggatgacaagctacaagcttaaataatttctctttctctctctctctctttctgtccttatagttctcatttctctgcttattgaggaaatcttcttcacagatcatctgcatttgagaacctctgccacacacgacttaatgtaatgctttgcacattgtaaaccctcaagaatgttgttaaatgagtaatcacaatgtgaattaagtcattcacaatggaatgctgctaattctggaactgagtaatgtggtcattgcagtatactaagctgcgtgaaaacttctagaaaaaaattatagagaaaagttgccttctcctttattttagcaatactattgcagcatataaaatcaagctgggactttatgggaagctgcgccttgctaatttaaaaggacacactgactacatgctgattggcttggggggaaggattgcttaccatgttgttttgtttctattttaattttcacctgcctgtctgcgaattttccttaccatggtaatggatttaaattaatcaataaggtgttatgaagatttaatgtcaaatacactttaaaaacctagtttgaaaacttccaggtctatttagcacatgtcgtagtgtggcttaacccatggtgcattaacaaaataaaggtcaaagttaaattttagaaaaaggggaacaatattcctcacaagacattccagtgggataaaaaacacaggtttttttctatattgacaaacctagattcttaattataataactcttcctaatggtctatatctaatcaggtacagtggaatattaataaacatgttttatattctctggttatattgttaatggatacttcaatgcactgaattagaaggcactacagtgcatattgttttatcaagggcaagtttattttgcttcatctatgtaaaaacacattattttttgaaaagataacttattatttaagggtaagagtattagaatattaaaaattgatcacagaaagagggatggatagatgaatatgtaataaatcaagtatagtaaaatttcaatggcaaagtataggtgctgggtatacagatgttgaccgtaaatttctttcgactttgctgtatgattagccattttaatattaaaacatcgacaacaataatcctaaattgtaagcactgtatctttacatacttgtataccagtgccaccattttgtagctaattccttttctgtaaatgtgattattaaacctttaacactgaaatatctggcacatgtatacatatgtaactaacctgcacattgtgcacatgtaccctaaaacttaaagtataataataataaaataaaataaaaattgaaatatctgaaacaaagttttagggggcgtgttcatcctgtacaacttactgagagatttgtaatgccctatggaccagaggtctagtctgaagtttgaggttatttttaaagaaagaataagaattcgttgaggatgggaagttgggtagaaggtctttgcggcagatggaagtattgggacgtaaggtggataatatccaggcagccttaaattttctgccacatatatcactcaaggagagtggaagaaatggggccttggagagattatgtcatgtgtgaccttgcatgctacaccaaggaggtgggaatttatcttaaaggtattgaagaatttcaaacatgagtatgggggtgacggcatcagccttcatgtcagaagataactctggctgaggaagtgatgctagatgcagaaagaccagtgaacaagttaccggagttttctaggatacgaatagtaatagcatcatcatcagcagttatagtgactattctttattaattgcattttatgtaccttactctctgtatggtaatctcatttaagccctttagtcaccctaagaaacagaaaactttatgaggaaactgaggctagaagagatttaaaaatttgccaacggtgacaagattcgaatcaggtatgcttgacttcacagtgataagggcctgaaaccatagagaatcatagagaaaaatctgctttaagacagacttaggaggtaaaatttgcagtcttttgtgtcagtgtagacatatgcataaaagagagaagtctcaccagaatcagaagtttctagcttaaataattgggtagatggtggtgccatcttctgaaatagagaatagaggcagtaggggatttcagtttgggacatgctaatgttaaaatgtctgtggccatgagtaagactcaaaatatttgacaactgctttagcaaaagcccaaccaaatagagaaaacactactcagtacaccctacctgtgcttatcagcaggtaccagtcctgtggtctaaatatagaagttcactggggagttgcagatgtcaatgtagaatggccaagaggggtacataggcagcatatgctttgagagtcatctgcttatagatactaattagagccgtggatgaagatgagatcacagaagagatgtggcatggaaagtgaagaagtgctgagggtaggatctggggagcagccatacttattatggaagaggctgaggatgaatcatcaggaaagagactcaaatgtcctatggagacaggtcaggtgaaaacctggggaagagggtgttagagaactaaaggagaaaattacaaggagaagctgagtcaggcaatttggcagggggtaggctattgattttcttagtgagagcagtttgcctggcacggtaggagtaatagccagataaatggactgaaaagtgagctgtgggtaaagaaggtgagctaggcagctctgctacattttcttttctttttttaaagttctatgattaatttttattttaagttccgtggtacatgtgcaggatgtgcaggtttgttacataggtaaacatgtgccatggtggtttgctgcacctattaacccatcacctagagatatatatatatatattttattattatactttaagttttagggtccatatgcacaacgtgaaggttagttacatatgtatacatgtgccatgttggtgtgctgcacccagtaactcgtcagttaacattaggtgtatctccaaatgctatccctcccccctcccccgaccccacaacaggccctggtgtgtgatgttccccttcctgtgtccatgtgttctcattgttcaattcccacctgtgagtgagaacatgtggtgtttggttttttgtccttgccatagtttgctgagaatgatggtttccagcttcatccatgtccctacaaaggacatgaactcatccttttttatggctgcatagtattccatggtgtatatgtgccacattttctcaatccagtctatcattgttggacatttgggttggttccaagtctttgctattgcccatcacctagatattaagcccagcatgcattagctatttttcccaatgctctccctcccctcgccccaccccccgacaggcctcagtgtgtgttgttcccctccatgagtccatgtgttctcattgttcagctcccacttttaagtgagaacatgtgatatttgcttttctgttcctgtgttagtttgctgaggataatggcttccagctcctcaaagatctagaaccagaaataccatttgacccagcaatcccattattggttatatacccaaaggaatataaaccattctattttaaagatacatgcacacgtatgttcactgcagcactattcacaatagcaaagacatggaatcaacccaaatgcccatcagtgatagactggataaagaaaatgtggtacatatacactgtggaatactctgcagccataaaaaggaatgagatcatgtcctttgcaggaacacatatggagctgtgctacagtttcacaaagtttggccatcagaagagggagagaattgacactaggtacaggtggaggggtgaaggagcagcaccggtaagcttggacaattgtttgtttgttaaaatgaagggtaccagagtggtaagctgacagcaaaggatcagtaggaaggtgacttaaaaagtatagaaggaggagattcttgacagaacaaggctcagaggagacggaatttagaacagggtgttagcctcatactcttgcaccttccatatcctatagtcacacaatagccagaataagttttttttttaaaggaaaataagtcacaaatttattggctattttcccaactagaatgcaaactccaatgaggcgcggtggctcacacctgtaatcccagcactttgggaggctgaggtgggcagatcacttgagcctaggagattgagaccagcctaggcaactggtgaaaccccatctctgcaaaaaaatacaaaaaattagctggacatggtggcacttgcctgtagtctctgctacttgggaggctgaggttggggggatcacccgagcccaggaggtggaggttgcagtgagctgtgatcataccattgcactccagcctaggcaacagagtgagaccctgtctcaaaaaaaaaaaaaaaaaaaaaaagaatgtaaacatataaactccagagggtgggaccactgttagctgcgagggacccgacttgccgaaccagtctaagatatttctagttactccttttctcttttttcgccctgtgaacaatttaatatttggcttcttccttttttttttttttttaaatttcttcctccctactcattcccactcccaaaccaaccacaaagctaacctcagctttttttccaaattatcccttttgcttgctatgaacacaagtttgaacctcagctctgttggtgataattttgcccataagaagcttctggcaaaaataaaacaaaataagtctttaggcctcattctttaggaggttttgctggcctaaattgtttttgctttttaatggtattttaattagtgtttcaccaagtgtggttctcaatcagcaacaatagtatcccctgggaatttgatagaaatgcaaattatcaggcccctctcataactaaatgattacactttgtggagtctcttcatctaaatgtcttcagtggcaaaagccaatgaagaaaatctctgtatatagttttttttttggtttgtttgtttttgtttgtttgttttttaatggttctcagggtttggtctctagaccaatgccatcaaaatcaactggaaatttgtgagcaatgtgaattctcaggtcctaccctatctgtaactgaatgtaaaactctaggcatgggaccattcaatctgtatttctacaagtcctctagtagctttgatgcatgttcaagtcggccctaaagtgttggatttataacctataactgtttctttctagaaaacaactatgtcgggggaaaaataaaaagaaagttttctattaattaaaaacgtagaattcaagagctaaaggaatctcaggacaatgattagcaaagataaatatacaaaggaatataaagtaaaaatgcaactgaaaatggctgaagagaacgtggactaacacataatgtttgaaacagagtatactatttaaaagctacatatgtgctaaatctcagaattcttctttccatgtgctagtttgagaggcaatttatttctggcacaactgccatatgcatttatactaatgtgaaagacttcttgtaatgagaaggtaatacactgcatttagtaaactagttttcaatgtgagaaaaatgcctacatgaaaatgttgccctttaaaaagcttcccttgactattcctgtttatattcttgatagcagaatagctttgggaaatgttctgaatagaatccaaagctactctaaagataggctgacaaggttgtcaccatacagttcctatgtaccatgaatcttagaatcaagaacgtttgaatcaagacatttctcagagccaatctgagatatgtgtatatttatatgtatctatttgagacaactctcagggaacaagacatcaaaaacaaattgatcaaaaggttatacgctcaaatgaatgttgcattttaacgcagtgagtaatggtacaatttaggaactaaactctttttgaaactgcctttcaagacagtttgcaattacaaaagaaatgttcatgggtatctactttttttatttgaaaaattgattgcatctaggtttaccattcatgcattttgttcaacataaaaatattttagactgacaaaaaataaattctactttcaaaatataaaaatttgatacctttaaagatgttaaaaaagaaaaagacacagaatagtaacaacaacgtaggaataattgtataggctcctaaggtgaccattaagaattctaacttacaggtattaagttttttatttaaaaaaatcagttgttcgaaggaaacacaatttcaattagacaggaggagtatgttcaagagacctattgtacaacatggatactatagttaacagcaatgtattatatacttgatacttgctaagagtatactctaagtgttctcaccacaaataaagtgtatgtgaggtaatgcatacgataattggcttgatttagccattccacaatgtatgggtatatcaaaacatcatgttgtacaccatgaatatatacaacctttatcaatttaaacaagataattaaaaatcagttgtattacttaagttgcttgttaaaatatgtatctgttactgtaatcaatacaaataattatgaagcagttcatgcatgctggcaaagccagtcaagccattcgtaagtgcctctcgttggcagtgaatgtattttttttccttggcctcctaaggcccttatgactttttctgggtcagctttgttaactcctctcacttagctccattctcaatggtcagcgaggcttgggattagtcattttcacttttcttggtacatggacctctctccccccgtactctcagtatttcaattatcatttgactgtagataagctcccaaatctttatttcagcttaatattctatcctgaatttcagactcacacagccaactgcccaagaatattccctgaacttgtccgccttttggatattccctaaacaggacacgtcctaaatcagtgttctcaaagcctggtccctcaccagcggcatcaaaatcatggaagaactttgtagaaatgcaaattatctgtgccctccccagacctccccaattagaagcttaagggtaaaacggtcatctgcatattaacaagttttccaggagattccagtggagctaaagtttgagaaccactgtcctatatcatgcccagcgtttactctgtgtatttataatgtttttaaaaaatttccatattttatggatgcttgaacatcttgaggtccttggaaggccagggagagactgcccctcccagggctagctaattcctaaagatagcaaataacttgtaaacttgctcccttgtggatttgttggattgcttttcgttatacaaaccaactaatccaaagtccgtatccccaactaccttcttcatctaactgttgttacaccaaaccaatatttcccccaccctaactttttcccctcaccctagggcttggtaccagacaaccagagaccacttttacagccaggaaattttggaaattatttgaactatccagtcctaaacttgctcagacttgcctattctacctcactcatttcttttccttggaaaccacaataaagggtttgggctgtgctttccttttctgcctgctgaccgactctggaacttttttcctgcatggctttgcatggcgtagtatgtactcttcccttgagaactgtgagtaatcaaacttcttttaatggaattgatctctctatattgtcattcagtcatttctgtaaagcaaatccctgtgcaactaaaataccctgcccctcccaacataatctaagtcttgggttccctacttcggtgaaggtttctagctgtccaaaaagtagaaactttactttttccttttgtatattaatccattactagatagcaaagtctatgtttttttttttttttttcaacttggaatctattaacctctttcccccacttataccaatactccagtttaagccaccagtgtgttcaactgggcttcaataacttaacgaaggatatttttgcctcagtttatgcccttcatttcaatccaatttacctttttaaatgaagtcactcctctgcttaacacagaacctttagtggtttttaccattgtcatgcaagtaaaaaaaaaaaaaatctgacccttactaactttctagcttcatctctcccaattcaaactctaggtttaccaagcagcaatcctctcaaaatcactttcccatgacttcagacttgtgcacagtatgttgcctggcttagagaatactcctcatgtttccttccccctacctgaccaacccatctcttaggtctccatttagatgtcaggaggagcctttcttcatgccttcaggctcagctattctatcattccgggttctatcctatcccatttcctgctatctccctgacttattgggggtcctatttctgtcaaaatcagcaaaggaaagcgggtaggggttaggggaagaaggaactgggggtgagaaggaagacaatatgcatcaggataaaggaatgagctgttggcattcttagttgaaactctgaaggcattttccatgagtgtaaacgctataatcactttcacagatcaccttcaaaaatactgccatgtttgacctcttatttagttgacattgttatctagattgacatttattgacccattttgttttacttagtctcaatgtaagcaatgatatcttaaaatcaactgtttatagtaccggctatatttgcctaaaacacattaaatagattaaattaaattcacataattagaattttatgagagtgagaaattacttaatgggtacaatgcatcttattaaggtgatggataccctaaaaggcctgacgtgaccattacacaatctatgcatgtaacaaaattatacttgtacctcataaatttatataaataaaacaaataaactcaatgcctcccaaaataaatacataattgtcagagtttgtaaaagtatcaagccatgtgccatgtaataatattccattttcattcttccagtgggaagtaaacaataagggaaaaattatagatgacagataatgtatataggtatgtcataaattgaattagcctaggaaattaattataatttatatttctccctgtggcaaatgtatttcaaataccacacatcttaattgtaaactaagtaaaaaaaaaagactacttataatctagaaggcccttgataattgaaatacacttagcaatgaacaatcgagtttattttgctgattcacaattcacaagtaatcttaaggtcaggtttctgattgctcattcgtagttgttttccaaagtgttgataatctaattttgtttgtgctccaaatgattcttccaatgcaaaaaggtcccagctgctttgcaaaggtaggtaggtttgcctaaaaatcaagaacgacatcacccacaagacattttcttgttaagttgcgaagtaacttttagtatattttcagactagtgttttcctagactagtgtaccccatgcatgatctgaatcagacttgctcttaatcttccattaaaaacaagactttcattctagatatgaattttagtctgatatcttattcttaaagactactttcttatcacaaagttctcacatcaccaatatccaaaccaagacatttaagacaacattctcaggggtgataaatgactacagtttttgcgcttttaaaataggcttgggaaatgacctgtattttgcattacgtgcatcataaacttctaattgctcttacagagtgttctgtaaaaaagaatatccaccattctttaaaaatactatggcattaagactgaagccctgagagatgttaagatagactatttaaactctgtagactacatttgggaatgcttccaaggttagcagtgaagagtgactcatcagtgaagggccggaagttcttttccttttggtttaatgtggatctctcaaactactttctaatatggtaaccactagacacatatggctactgagcacttgaaatgtggctgatctgaactgagttgcgctgtaagagtaaaacttaccagattttaaatacttaacggaaaaaatctaattaataacttttgtaacaattacatgttaaaatgacaatgttttgggtatattgggttatatacaacatactgttgaaattaatttcacttctttatttttattttttcagtgtgcctactagagaaatttaaattacatatgtggctcacattttatttctactgggcagagctgctgtagtaaaatgaagagaacaagaatagccccacagatatcttagttttcattgttacaagccaacaatttattagacaattttctctgacttgaaatgacacaaaaatctcagagagatcctgtggtgtgagcgtttggagtcagaggcctatttttcatggaccattgttctggtttagtttaacaaatctactatagtgtaatatagtataaactatttttgcatttttgttcatttagaagtttatgaaagtcagcaagatgagcatttttgtgattgatgtatgatgcaataaattgcattgccaatttagaaatgtaataatctgaatttttgatcatcaagtttatgcataatgtatttttgagagaaaataaacacaagcaaagaatcaatagcatttccccagcccccaatcctcgggggagattctctctcattatatttaatttcctctttgaattaactcattttaaaagacagtaaaataggctcaaatgttttaattgtatttctgatttttttctgaagttaagagcaaagtagactgagtgaattgacagatggtaatgattttgcacaccatttatttcaggactaacggcaagttctattaaagtagttcctcctaaggagtttatctcaaccagtgaatttccattcagcctttaacacttgactcaaatgccacctcctcctctaaaaagccttgcctggtcctattgggcagttatccactgcatattctcctagagcattatgccttatatatatttctcttattgaatttctcctcgctgtcccaaactagagtgtgtgcttcctgacaacatggctgaagtcaacctgagtcttactaatctctgtattatcaatgactagtccagtgcccaacatataatagacatccaaaatgtgcatatattccaggtttctcaatgagatggtattaatattgccaaatattaggtatagtgtacttaacagtatgtctagttaaaacatacatatattctacatatatgtagtttaaatttctctagtaggcacagtaaaaaaaaagtaaaaataaatgtatacatatattctacatatatattctatatatatatatatatatatatggcacatagaaatattttaatgaggaatttgatgatggccaattttcaatgatttaataaccaagtcaatttttaattagagacaatttataagtaaaaattgaccttgaaaagtgtctcacacacacacacacacaaagacataatggaataataaaagaccttctagtcaccaaattaaatatttgtcttctaaatgcaatcacttcgattacgtttgctgaaaggattacccaaggctctttttttgctacaattatttaattatactcatggttttgactcatttgtaaatgcccatctgaggttttattaatcctgctcattactatatgttgacccagtctattgtgatctcatctctaaggttttatgagcacagcctgatattcatgaaattttccaggggtttgtaaaaatttctgggtgatcatattattaaaggtagttatgtctattctcgaaaataaacatatcttttcattacaatgccaaatacatgatcgtgggagggatcaaagaagtgtgtacatgatttagctgctcaactggtttaattactcaacacttttagctatgaagagagtttagaccattataatagtcctagattttttattcttataatttatatccatatttagagcattggttactcatgttgaaatatataaagggttgaagaagttataagggatcatatttctccagattttactccagatgatcttcagagtaagtcaatttgtaaaccgcatatagaaaatctaaaagtggaaatttttattgcctccgtattacagaggagaaaatggtggcacacagtttaagtaatttgccagggtcataaaggtagctggtaaagacttggagggggtttaaacccaagctctgtagctatagaatcttccaactggatactagacaaaacaaaagttcccagagcttcgctgcacattagattgagctgagtagtttgtaagaattatgatgcccaagtcccacagaacaccaataaaataaaactctcaggaaatcttgtgaaaaccaaagtttcaaaagaatgaaactttactcaattgatgctcaaagtgtattttgttaagatgtacttgaaaatgtcatttgagcctctcttatctgattgtttacagagcaaaaagaaaaaaaatagctaacttctgataaaacccaaaaactatgaagaattccccatgcctcgtcataaaagtagctttttcctcgactttatagattttatttgattttaaattttagtccacattttcatgtgtatttggccctcaaaccaagcatgtaatttaaaaaattgttaactcatactttttcttatgtaattagagttaaaaatcattgttaaagtgaaaaaaataaaacgtttgtctatataatgaatattattgtaaagcatattaaatgttaaataaaatcctaattaatatactaatataagctcttataaagttcaaataattaaacaatatttatattatcaacatttcataagataaaacacactaaataattaaaagctcttccaccatgcaaaaatgactaaacgattttttaatttctaaagctttttgagattactgtgaaaggggacatagtttcaggaaaggtgagtaaacactatattagactagcatttctcaatttttatactactgacattttggcctaaataattccttgtggagggctatcctatgcattgtaggatattttataccatatctggcctctacccactagacttcagttgtatctccaatccagtaataataattaaaaatgcctccagatattgctaaatgtccacttggtggaggtaaaaatatcccccgccccccattttgagaaccattgcaatagacaaattagctcagagttatgtcatctctaaacaacttagcataaacaaactagagaagccctttcgacttctggtctgaagaattctgcgtgtctataatacaagtttaattgatatgtacctaagttattatcagctgatataacaatttgtgatgctttctgaatcatcaaaaaaatgttgtttgaatgcttaagatgcttaatgtgttttgtaatacagtatactaaaaaccttggaaatcattaattaactgaagccatataattttgatagtttggttactgggcactttaatctaatctgtaaatcttccaatagatttccaaactcagaattttcatcctgctctgattggttaatctttggtgggatttaccatttatccattgcattataattatttgctgtgccttatcatataaagacaaaattgggtgtggagtagttgcccatactttccagggcatatcattgagacccacactcagtaggttattatgttctttaatggtttacacattgaagggaagtttcacctttcctgaaactataccccctttcacagtaatctcaaaaagccttagaaattaacaatttatttagtcatttttgcacggtggaagagtttttaattatttaatgtgtttatcgtattataaaacattgatcatataaatattgtttaattatttgtactttataatagcttacattagtatattaggatttttataacatttaatatgctttatagtagtatttgttatgtagacaaatgattcaaatatttgcctcattgttaaaagctcacttaaatgttttgacataagctcacataatttgaaaatattaagaatttgaagctatagaatttgaaaacattaatgcattgaattccatatggaagaaagtctgtttagttgagggacttcaatatgcttccattttccacttctgaagatctgtttcggctcatggtaaatattacatctttaccctcgctccccaaatgcttcagatggattaagcaccattctttttgtgtgggggagctggagagagaaatagatgaatatcttccacacccttgattccatcctaacaagtaccaataaatagcaacttctcacctcctctatagaggttgtcttcaattaaaaatacactagagagattataaccatagaaaggacattgagtagtgctttcggctaattggcagtacattccttccaaaatttcagaggtacctcaatttaatgactcccctgaataaagtaattggttgaaatttactttgcagttcttaatataactttgggcccatcattagcaagaactctaaaaaggaaaaacaaaaacaaaactggggtcagtatatatttaaatgaagcacaaggaaaaaaggtatttcactttcaaaggacctatgctgttttttttttttgaagattgcaactcatctattttataatataatgacaataatattgcctctgagttaactgtgtaataattcactttgggtactgcaataattgagcaaacagaagctggtaccagaggcattcctttcttttatttagtgtaatattttttcataatttaatgagaaacatttcaaaagcaacgtttttatcctttcatgttaaattaatttacaatgctataagctataataaaatgagagaaaccatcagcaaaaagcaaaagttaataaagacagatattcttaaagtttcaaggactgaaaaaagctcaaatcacaaaagtatttggtttctcctttttttgtggcttggttcaatttgtcataatttgttctcaattattttgtacttacagctagcataacataatattgatgaaggagaaaagatgcattactgaaagtaaacatacataattaaaatcacctaagaaacaacaaaactttgcgatgtacttcagtaaactactctaagatttatacaaagaaggctatgatgtaatttaacatgtactggtataaacttctttgggcaaaattcaaaatttcaagcgatgatgaataaagcataaggaaagttcatgttattggaatggagttctctgtttaagcatattatggacactccaatttgacagatactactctgatacagcttaataaatttgtattcagctgctgaaacactaacgagaattgagaagacctgggctgttggacctttgaagtccagagatttcaactctcagaacctggttttcatctttaattgatagaattggacaacctcaagaagagagtagtttcacttggagtgatggtgctgggctgctcatgaggattctgcaggttaaatgcagtcaagcactatagcacggtatcaggttatttgctatccatagactagataatagcaaaagtccttgcaaatttcaaagttctatgactcagtgagaacatttattatttagccagcaagtaagcacatagcccactattcagcatgtgtctgtacatataacatcctagagccctactactcaaagtgtgcgccagagactgacagcagcagcatcacctgggacctactgaatcagcatctctggggttggggctaagtaatctatgttttaacaagctctccaggcaattgctatgcatattaagagaagcactgattcagagcattgtgagaacatagaagatattctaggctttgcctcaagaactttagttttggataaaatagatgtaaaacaacttagcaaaatctttcataatgaagtaatatctgtaggtcattcattcaacaaatattgagaacctactatttgttaggcattgtgttagtggctggggttataatagttctgcttttgtgacgcttacaatctagtgaagtatacccaaataaacaaatatataaattttaaaaatacggtttttaaaaaatactatgcaggaaataataatggtgctatgaaaacaaagaacagaaatggctttgaggggtggagagtgatacatttaactttattttaaattgttaataataatatgttaagatttagttagttgataaatcagcaaataccaactgcatgcatgctctgcacccagataagcatcttgtggaatataagagtatgccctggaggagtttataatcagttggaaagataagatttaatcaccaactataatcagtatggtgtccgcagtagaccactttagaatggccctttgttgaaactctctcctctctgcttcttacttaataagcttttctggttttccaattcctggttttctaattcactgtgcaagacaaattttaaaaagagaaatcaatgttggctgaaattaatgcagaatgttctgtggaagaagaattcaagatgggtcttgaagcagtagtagaatgtataaaggtgaagataaataaggaagtcattttaagaataccactattgttagtattaataataactccaatcattttatttctaataactggtactgtcatgaaagatgatctgttaataccacatatcagaagggttttagttcagccccagacatgatacattgtgtttataagttttctttcattactttggcaaacaacgtcttttgattttaaccttcctttcaatgactaagggggactctaataagtatctaggtagaattgtcaaagaagatgagtcagtatttacatattgactgttacaagcactacacaaatggttgttacataacatacttgaaatgaaattagagttacctacgcaaatatatgtgtgtgtatcttgtttttttttttttaattgagagagagagggtctcattctgtcacctagactggagtacagtagcatagtcacagctccctgcagccttgcagccttgacctcccaggctcaagcaatcctcctgcctcagcgtcctgagtagctgggattacagaggtgttccaccacatccaactattttttaaaaaatttttttggtagagacggagtcttgctatggttcccagactggtctcgaactcctgggctcaagcgattctcctgccttagcctcccaaattgctgggattacagtcgtgagccaccttgcctggctgtgtgtatatcttttaatgttaaacttttacagtagaaatactcactatttgcttttcaattgcttgctctgaagagcacaatgctttactgaacagagatcaaaaacccacctagttaaacaggaaataagactaataaaaatatttaatggtcttatttaacaactatagaataaaactgaaaacagtacagtgaaataaagaaaattcctttgtaccaatgtcactgcatgatatcggtactaaacaaattgttctcaggagctacaagtcatattcaggtggtcagaaactttaccttacacaatgagaaatgtagtatctgaaatatctgcaactagttaggtttaagaaaagaaaactcttaccattgggggaaaataaatccttttagaaataggattgaactgtcaataaagctgtttataataaattcttataaagtttaacatgaaaggactgtaaaaacagatgttattcaaaagaaaatcacatctgatttttattgctacagcctctcactgacttttgtctcatttttcatggaggcttttaagttttaacaaaatacaaaattgaagagctttttaaaagaagagatttatgcgatgtatagaaagattttctggagttataaaatcctgatcaccagatatacttaggaaatgattaagaaggctgaatggtaaacatagactctagaaatgtaattatcattttctctcttcttttaattattaaaaatcttgcatttaaggtctgaagtttgccagactaatccaaatttactagtgagaggcatccttgaattctccttaatctgtttagttacttaaaatgtttaagactttctaatcaagagaagcctacagtctcgaaggcataatgttctctccgaaaccaatttaactttaggttatttaattggaactccaaagaattagaagttcattctatttccttggcattcttcacagcacctggcacagtgttaagtacatattagatgctcaataaatatttttgaaggagtgaacattgcttaagagggaaataagaggaactattaagatagaagatatttaaattcctaaaattatttcttccctattcatggagaggatatgattagaaagacaattgtatatagttttaataaaatctatttattttggttttgtttaatgcaattccacaagcttttactgagtttgcactatcttgacactgaaatgctgaagacattttaaaaattacagaatcactcaagaagcttaaagtttagtggtgtgttaatttgcagatgatttgattctgcttttaacttgtttaaggacagtgatctctgtttaatgccacactgaaagtactatgtgttcataataaacaatttctgaatgatcttatgagctcattagtatgtctcatgtggtttattgctttaaaatctcataatcaactatggtcatttttttctgcactagaatgtaggtcactgagctcaaatttatttcttatttttttttgatagggtctcactctgtcatccaggctggagtgcagttgtgccattatggctcactgcagcctcgacttcctgggttcacgtgatccttctacctcaggctcccgagtagctgggactacaggcacatgccaccatgcgcaggtactctttttgcattttttgtagagatggggtttcaccatgttgcccaggctgatctcaaactcctggactcaagtgatctgcctgcctcagcttcccaaatccttgggattacaggcatgagccatcgcaccccaagtgtatttctataccttacaaagtaccttacacagtaactaaccagcaaatggcagatactccagtcatagatgaatggatatgaatctactgttgaatactaatagaaattgtaacggcacagttacatttctgaaccaattctagaggttatacattcaaagaaggagtattattattaggtgcctaaaattgttagtaaaatagacctcttactatatttatctggattcttatatcatgcaagaaaatatcaataaacaagcatgccaactatggttttttttttttttttttttttttggtatccctccagatccagatccattttcccttctttttccaccttccagggggctgacttggattacatcattagactcctatgccctatggttttctgtttgggtttgaccaaggagaggactagcaaaccactgcagagaagggagagtcttgggtcagagtattgattcccttcatctctttttccctgagtatcatttcgaggcaaattctgtccttaagagaaagccactgctcctcccaaggcattaaaatctgcatgatgttttttttttttttctttttttctgggctctgagaaacctctctccccaacaacggcttcaggtctaggagaggtgacagctctgctgctgctagtcctagagtcttgtgctatcttgtgagatttccctacaccctgcccaatcctgagtatgtagtgccttgtaaataaagactcctcaacttaccctaatctgaatgtgccatctgtttcttgttgggactctgactgactgagatatcaacacaaatacaatcatgaaacaggacacaaattcagcacttcacagagttattgcggtactatgttaatgggcatgaaagttatcagtaaactgtaagtgccataccgatgttgattgctatcatttagcacaaactatgaaaagttcagactatgtccatacacaggtgtctcaacacaaaaccagttgacatggtctaacttgatataggattgatgtggctgtactgtaacagttgtccaataatcatgttgtaaataagtttttaatatattaacagcatactatattgatacatatgtaatcacagtgttatcagacttatccagtgttaatatggctgaccatagacaaggtctcaatattccattatccgccagtctgttccagatcgtgggccacttgtacatgttcctagttcggaatcaattaagagactagctctgtgaagagacgggaagcataacctttttctgagttataagtataaagtcagccctgcattcttttaccctgattggggctgagctacattacaaatctcctttgtctcttcaagcttaggggagcttgcaggaaattttctgttaagaatttatgtttttatgaaaaacaatgatactgagacacagagtgtatgctacgaaaaaaataaatacttttagggtaaaaaaggaaaaaggtggtattaaaataaattttcccaaatactgctctttatatatttcgttagtgacatctacacaataaccatattttgggaagcaattaaacacctcacatggacaaaaatcatatcggtttcttactatttgggctggcagtaccttataaaaagaaaaaagcatcaaggcactgtagtatgatatttttgaggatgtttttcctataaaaatcttcaaatgagctgcaaatggacccaaacagacttattttaatatactctaggaccatatataataaaaggtcctatactattttatagaaatggcttctgttgccttagatgaggtttacacataaatcttttaacttttagtgctgcttgtttcacttctggtggattctttttacaacaatgccctgccaagcagttaatactacttcataaaggaagacgccaccccttgaccttcacgtttgtgacccataatgcaaggtgcttccatcatctctatcttttctagatatcacccttccttggaagtgcagacaagtgttttgtttatttgttcttgttttgtttgaggtcaattcactggctcctttctccagtttttttttttttttttaaacaccttgaaagcttctaatacatctgctagccaaaacagtcattttcattacatgcttgtggctggtcaaaaagaacagttgtataatttttattttcttacccagaccacaaacaggttataaaaagtacatggcccttaaattttggcggttcctttaaaatttagttcaaaagccaacatgaagagtcagatggaatgactgtcacatggaagagctaccaagcagataataagtttagaactcttaattgaaaattaacacacctacattgtattcccaaattgaagaaaacggctgttttggctactgctataataagatgctgcatacttcacatgctgaatctggaagggggagcaattcagtcctatctgacggttgttcctaagctttagtataacttcaaagatgagggtatgaaattccgtcatcgtcagagagatcctgctttctcttccttgggttgcaaagttagtaaatattagccttccattttaactaactcgttgagcttgtctccaatagaagattgaattattggcctcaatcctttcacatccctagtagtatcatacattcacgctccagccatggcctcacataggtggaaagtattttcctaccccttgactttgggcttggccacaagacatgttttgtctaatgggctataaacaaatgtgacaagaggagagattttgaaaagtgttgtttgtgcttctgtcattgccttgtgctactctgtcataccccgagtagctgatgtcccttcagcttgagtctcagaagaaaatatgtggtatagacccgaacagaaccgacggcctagagataagcatagctaaaccatttccagccatgattggccaaaccctaccaaactgcagctccatgaataaatcaatattgttgttattagccactgaattaaatttttttggttgtttattgtgcagcaaaatggactgatatgaactgaaatgtggtttataatcaatacaatccagtaaagttctactaaatgtatgtctatcaagcaaaagaaaaaaaacagatgattagaaagttgtcaaattcttctaacaaagtccatatacataccaggtaccagaatgagttatcaataattgcctaggggtaagggttagaaataaaaaaagtcaagttgaacccactaggtcgtatttccaggttttcaagcagactgttctggtttgcaatatttgaaaagagtctgctgtggtatgctaatgactgtgaattctgtggtctttggaatagttccaaaatgctaagctcaagtttaaaacaaaattggattctcaaatatctttcttgctcagaaaggatttaagtccttttgtacagaaaggaacaaacaagtgataaggtaccttttgggctttctattacctatgtttccagagtggtaaaactggatctctcttgttttcagtcatatctacaggttccctcctaaggatgatccttcctggtggcttctgtttacaacaatgccacgccaagcagttaacactacttcgtaaaggaagactccactccttgaccttcgcattcttgacccataatgcaatgtgcttccacaatctctatcatttccagacatcacccttcctgggaaatgctgacaagtacggactgtgctaaagggtggaggctgtctttcacctcctgccaccaacagcttatttgaggagagtttaagaaagaagattttaccagaaaagttccaatttcatgtgcctctttatatgctttttctgcttcttatgtagtctccaaatttgaatgacagtcttcctaactagtaaccttggaggaatataggagaccaagtgaggaagctatcaaataatttcttaacatcaacattattgaaacatagtaactcattgttttacattggaggctaaatagaatgatatgttttaaaatggctatctccatgggcttattttttttttctcatctgataagtggattcaatgatttccaagattttgttttcaactctgtgattctatggtctctggatactgtagttccaaccttcaagagaagagcacatctaattaaagttcgagacagcgccaaaagattagcagctacggtcacatttaatgagcaagtcgagtgaaggcatttttcccattgtctaggagtcacctcaataggatggaagatgcacgttctatacagtcttatgaccagcctgttcctcagcatatttttcctttaagtaccaaacaggtatatgaatttagaatataaaaagagggttgtgataagttgatattttcttctccaaagtttaaatatttgaatagttcaccagctgtagctttaaatagtgggaaataatgcagctagaagaaccatacagggaaaaagagtgagttgaaaattctcagctcagtggttatcatcaagtttggttcctgtcagcctccagcgactgtaggtggtgcttataggtattcatcaataaaaggtgcatttgaggggatttccagcattttgcttcggaggaaatcatttatgtcaaaagattaaaactgctgttttcaattgcttaattgagtatatattgaggttaaggttagtgaaagtggtaaagcagaatgaatacattgcttattacagtcaagaaatgttatacagaaatgagaaaatgtacaaaccccaccagccataaataaggaagtggttagaatgtcgctctcagccaagggccctaagtccctttgtgtaggtttggaaaaatttatgcctgtctagcagcttgtagctgtggagcagagttggctgaccaaactttgattccttctctgaccatgttctgctagccttatgtccttcagtaaatgacagttgccataaaaaacaatgaggttgttgtatactccatcattcccactactttgagatcttaacaagatcacataaccatctgaacttgaagacacagactgaattcaaataattcaggctaagacatgtgctgataacctaagaaaaattattgctagactcctaaaataaatactatgagaaagaggccactttcacacatatttttagcttgaaaatgtgtatctgcatcaattgttaaaaaaaaccttttttttggataaatgggaaagtataataaattcaattttatttttaggacatgaatggatgataatttgtgggcacaaaaaagaataatttgctaagctttagtagcagtgtaatacattaaaatgcctgtatctcttgctctaaatgaatcaattttaaatatatatgaattgaatgtatcaattgagatcttaaaatgagcaatgaatgtggtaataccaggtacagataatttatgtgttctaatattatttagaaaagcatgccataagctgttcttagctaaaaccaccataattgagaaagaaatacttgagaagagattagatattctctactagttgaatggagcagtgaaaagtagattttggtgtcgtggttttatgaaaaagaaacatcagaaaataaagttctaaatcatttccattaaacaaaaacaaaaaacagagtttttggtatggcttggctgtgtccccaccccacaatctcatcttaaattgtaatccccataacctccataatccccacgtgtcaagggagagaccaggtggaggtaatggaatcataagggcagtttctcccatgctgttctcatgatagcgggatctgatggttttataaggggctcttcctacttcgctgggcgcttctccttcctgcggccttgtgaagaagatgcttgcttccccttcaccttctgccatgattgtaagtttcctgaggcctacccagccatgtggaactgtgagtcaattaaacctctttcctttagaaattacccagtctcgggcagttctttatagcagtatgaaaatggactaatacagtagctttgtttaagcaacataagtactgaaatgaatattcaaatataaatcatataggtggataaactgatcttatgaaatggggttctgtcatagtttttggttacaataacacacaacgtacaatgttattgattactgagttagctaagaggacttctcctgttataatattatacataatatcacaacacagttgctttcgttataaaataaagtaacatgtacattctatctgagattaagagaccaatggtgaatatattcctcttcatgggatcactgcactaaaacccacggcttttatttattttacaaaaatttctagttaatgatctaaggatttagctttttattttttcaccaaaccaaggtatatattgactggaagtattctgaaactattatataaaacaaaacagcttttgacttttttgtatcagttgtttgtttgaaagttgttcttcaagtgggaacatgttttcttccattttaaattgcagtcttacagatctgtagttttcttttcatggggacaaaattcgttttaagaactctggtatataaatctctggaagagagcattcacaaataaattccgatcaacagattgcatacatttctcaatcagctgtgcagactgagcattttcacggctccagtcatttcataaagatgattcagaattaatcagtcctactgctacttttattatttatatattcacagtattgacagatttcattttcttcccactctttactcctcctctataggaataacactcatgatgtggtgcgggcagcaggaagacctatcatctgactttctttctttaaggcatcactcaactaatcctgagaacctatgaacaataatggtggatatgcagattcacatcaaacttctgtttggttcttcaagtgttctctccagaatatgaagtccactaattctttagacctcagtagaggtatgtgaagcatgtagtaataacaatggctacaatgacacataaatagttatggctgcaatcgctataggtactggaacaacattcctctaggaacaatgacatcaagaagccttgcagagagccaatctcccagaattttgagcaatcaaactccttgtgacattttagaatgcactgcatcttctcttagggttactaaaaactacaactatacctaactcacctagcaacagttcatgccgctaattcattttaaagatacattaacagtagtcttttcatatgtctctttgaattgacttggctgtgtctcttgaaaggctcaaatttgattaggccaaaatgcagaggaaattaatgttattctcttgtgccatttccctaaattcagaaatgtaaagaaataccaatttcaaatacagacaagtctaatgttaaatgaagtctgaacatataaaaagattgtcgtcaagacaaatccattgcctggttttcttcagctgacatctatttttatgtagacggtatgacttagattcagggactaaacatgaagaaattcagaataatccaattattcaaaaggcatgcaaaaactattatttaaaaaatctcttttcacagtgtttttgttttgagtactatagctttgtaaacatttaattatctagctttatgggtttcgttttaatgattgtgccaacaaatgataacaataaatccatgccaattttggaagtatttctaatattatataacaaattggaaaggaattttgtacatgattatctctaggaagacaaaccacaagagtaattaacagagctatgattccattatcatcacaagggttaaaccagaagttcatgttcactattttcatatatctcacaaacccaagtatcagttcagttctcctggaaattcatgaaggattaaaacaaaacacattattaggcaatattttgatataaggagtgggtagctaatatgttttccaaaatttagtacagaagtgtgtgtatcatctcaagattggcggtaacacatgttacttacaaaaaaatgagcagaaataaacagtgtgtttatgatgtataaataaaatataatgacatcactagacaagggaacatctactttttggaaatttatttagggcagtgaaccattaaaaaataaaacataggctttatatttttatcatacagatggctaatattattaattttcaatatgcatttaggaaaaaccaaagtatatttactatttcaattagctattgtcacagtaatgtagaataaagctcaatggctttatgcaacaatcatttcttttcctggatgtgaatggctagtgcagccctgctgttcatgtcttttatcgttttcctgagaccagcagcctagatggacgtgttctcagaatgatagcagaagcacaaacaggaatgtatagatctcttaaggcctaggctgaaaactgtcacctctcactcctgctcatttaccatttgctaaagcaaatcacatggccaacccctaagactaggggttgggaagtacattccactcataaggaggcattgttaaggttgtgattgcagaaggtggagaagaaatgggattaatgattaaatctactacagctacataacagtttctttaaagcagatgatatattgtggaacatgacaatgatgtgtacttacttatatctttgactgaattcttcagggtgtaatttttgccacaatatttacccgtgctagatgattgttatgtatttttattgttatcagtgattaacctgctgctaaatttaagaaatagagaatcttactttttttttccagattcttgtataaggaattaaaagacatattttactggaggcaatcctttaacagcggatgtgagtataggcagactgatgcaatgtctagtctagggagcagagcatgccatctgagtcacgagtcttgtcttactcaactctggagttacttacttgaagagcatatactatatgggaattataagacaacactgcccctaaggagtttgggaaaattattttcttttccaatacaatatgcaagaaaatatttcacatcatgagatttagtcacttcctgtaagacaaccagagcaaaaagtcttcttagtcagatacaccatgtaggcaaactactctctcatcacctgtgcatgcacgtgtgtgtgcgtgtgtgtgtgtgtttgtgtacacattctgtctgtttccaattacaacttacttttctcatctcgtctttcaaattcttgtttttctggtggtgttccatttttgtaaatagaaaagtaaaagaagagtgtgcttaaaaacctgctcagagggtgaatttcaaattggcgtctctattagaggactaatttgctttctatgtgcaatcctggtgtgatcactgttgcatatgttactggatttcaactcctctgcccctacctaaactcattttgagactctcacatggtaggtcgatagcctgagttttatggagctcaaatgctgacatgacttctgtcagacttctggtgtcacatttggtgaagcaccaggagaatattctaccatatttctctttcctttgtttcactaggccagagtagtcctctctcccttgggttatcagactttacacactagcaaagcatatgattggcatttttctcttgcttattacccactccattcctctctctctgtctctctctctccctctccttcccattctccctctgtccttcctgttctccctctctcctttctatcctccctctctccttcacacttctcttctcctctctctgtctctctaaaatcaactaattattttccattttaatcacattcataagtcaatatattttatgtgcaaagaaatacatattcaagaaaaaagttcaaataagtaaaacgacaacaaaaacctgtttcagaataaaataatcttctttgctagaactaaccaagttctagctggtgtctttaagacacaaatttggctagaaagttactaattaatttgtaaaatatacctgaaggagttgtgccttttacgggatacttagataatctattcaccatcagtcaggggtgggtaataactctctgactactcttctgtactttttatcttatatacagtctttcagacagaatctatttcaatacagtaaacacacatacacattccaaatcaaatcaaaacaaaaccttttttccttctcttgattaactttacttttgagaaattgattataatgaaacatgtttaacaaaatgcatttttatgataaagagaagattccctaaatcaagactgagacataattgtgaaaaattcagccagtattataattggattaagttatgggattcaacctgaaaaaagaaatttttattctgatattgtaatttggtcatattaggctaagatataatttaatgtcatgagtcattagagtgtaacattgtactagtgatcatggctctgatggaggcatggacagtttttatgcaaagggaaaaacatgaaaatggtaatggaagcctttaggtgtcatctggcttagcttttccttttgtatcttcaaaacagtgggaagaataaacaatactattcttgattggctagccactggagatggggataccaaatgaaaaaaatgctccaacacaagcaggaagtattattttcttcatttctttatcctgcaaaagcacagagactctgtcttgcagaatcatttttttttttttcaaatttcagagctgaaagggccataagcaaaacatctggtctagtggttctcaaatttaagtgggcacaagaactacctaggggctctttacatatgcagattccacgacccatccccagagagcttctgacacaatgcatttttaataaagtttccaagtaaagatggtgtccgtggtatgtaaacctggagaaacatatcttttacctagatccatcatttttcagaagatcaacctgagatctccaacagcactgacttccccaggattacagaggctagtgtttaggaacaggaccctaacttcttgacttaaaataagatattttgcactctctaaataccttaatacttctattaaaaaaagttttagagtctgttagctgaagaagctgtgcctttttaaggatacttaaaagcgaataggcttttccccatttttgtattgtggcaaaatatacacaacataaaattgatcattttaatcatttctttttgatttgggatcttgaccatgctggggtacagtgtcattcactgcttcctccagttcctgggttcaaggaatcctcctgcctcagcctccagtgtgtctgggactacaagcatgagctcccacacccagttaatttttgaattctttgtagagatggggccttgccatgttgcccaggctggtcttgaactcctgagctcaagtgatcctcctgctttagcctcccacagttctgggattacagaagtgacccacaatgcctggccatttagcctttaaattttttttatgggtacatagtaggtgcatatatttacggggtacatgagatattttgatataggcctacaatgtgtaataatcacatcaggataacggggtaccattttcttgaccatttttaagtatacagttgagtactattaagtacattaatattatattattattatcgttgaaccatcaccactatccatctctagaatgttttcatcatcccaaactgaaactcaggtactcattaaacaataagccctcattctcttcttcctccagctcctggtaacatccttcaactttacgtctgtataaatttgactgttgtaggtagctcataccagtggaatcatacaatatttttcattttgtgtctggtttatttcacttagcataatgcctctaagattcacccatattagctcatcttttgatttgctgaattcttttaacttcttgttcaagatgatgttctggctctttaagaaatgaatttctatcatttgtccaacttcaatagatagctgctaaatgagagaaagcattcagaaagggcattcctgggtgaatgaaatagacagagcctggaggccggcatagtgatgtgaaatgcattttctacttagttgaaagtcacttgaaaagaaaaagaaataggaaataagagagacaggaggagaagagaagagagatgaactaaactgagaaaaactaagactttcttaaggctgcgctgtgctcagattagtagggctatgcaaatgaggttattaacaggtatattctaaatattaattggtacacactggtatacatggaacccgatattattaaaatacctttggggcaaactatagacaaagaaaagcaaataaagaagtgaaataaagaagtaagcatctatgttgctattcgagaggtatttatcgtgcttaagatttaattttaatttatatagttactgtcatgagcattttgcagcttttaagtcagaagggaagttatttaatttatgttttattgtagaaaaaagtttaaagttttaaaaacatcagtatactggtgtatctccaattgtacacttagaggcaaggcctggtaatgctttcgagaagaggtagggctttggccaagagttgaattttccaggtagacaaggagagaaagggtattctgagcaaagataacttctcttgactgggataatgactacttgctgtttagtattcattcagctcagtgtcatttataagaaactttgtatggcagctttaattaaatggcatcaaaactttttgatacttctccatggaaaggtggagtttatgttctcatccccttgaatcagagctctgtcactgattgacaaatagaatatgggagaagcaaaaccattcttgcttttagggcaggccttgagaagcttgcagctttaatttcttgtcccttaggataattgctcttgggacccaactcttacactgtgaaaaagcccaaactgctccatggagaggtccacatgaagaaaaactgacagtcagcacctattttccaggcatgtgagtgagccctcttggaagtgaatcctccagcatcaggcaatctaccccaactgatatcaactgaaacagggataagcaagccccattgaaccttgagcaaactgtagattcatgaacaaaacaagtaatttttactgaagccatgaagttttgggctggcttgttatgtagcaaaagttaactagaataccttctctgatcttactcataagggatgcagaaggtgccccttctcttggatgactaaaggactttgtactctattataatatagcccttccttccttggctaggtctctctgtcctcctgccccaagccccaccactattaattcctcttttggggtagttccatatcttatcaacttgtatattttcatgcctgtttactgttctgtagaagatcccacttcttaatagctcttcttaaaagtcacattcaggaatccattcaaaaagtacattttccactacgggtatatattgcatgaatttcaaaatttctttcaggtcatggatgaaagatgaatttagggttgtctaatcaatgcaatggttgcatccaaataagaacacttgttttccactccaaaagagaatcaacaatttaccataccaggtgaagaagctacctctactcattgcactttttaaaactgcattgcacagccattttccaaatatttgtaaagctactgcaaaaactaaaaaggatttatggagtaaatcatgggaagaatgcctggtcaagtggttcataaatatccaggtctcattctatttggggtcacagccttgaatttaatccaatattgaattgttgaattgggagcaaagaattgaggtgaaatgtggttggctcctgagagcaactgaaatgctgcttcctgcagagaataactttctttgtaactcccagagaataatatatttgcaaaggtgttggaggtgaatagatattagagaggaaaaagtaaaatctttagagaactgaaagattatatttatgtgactcagatcattgtaagttattataatgctaatattgaatagtcaatagtcaacatgctaacagacctctcaaggacaaccacagactcaggagcaaacaaaagtaatttgttgctttctcactatcaagaaacagacattcttccatctagactaatatgatctccagtgggaaatgatttatgtctcttacattcatgaaactctctctcataaccaggcgtaatgacttcttttacctcttcggagaatggctgatttatgcacagacctttgtgcaataacttttctttaaagattgatgctgttaaacatgaaaaaaatgtgaactttctgacattttattttaatataatttagaaaaccatgtaaactgcaaaaggacctcatgtggaatgaaaatcacatgctgataacctaaattattttcaataccattaatctttgactaatacctggaatgttttattatcagaattatgaaaggcacaagagaggcactaatgtagttcatcttaaaaataatttaaaggacttaagattctttttttatcccctcaatttacactttgagaattttccagtaggatgggtagtgattgttacctatcacatagaggaatatcattttttttgttttggtctagaaagtctgctcccaaagaccaataaccctaaaaaattattcaaggttagaggaagggaggaggagaaagtgacacaaaattctttgacatttttctgtggtcaaacttttcctgaccttttcaattcttgtttggagaagaagttctgaaattatgtggatcttgtccaggttctaatggagatcaaagaaagttggcaaatagtcccagccttctcaatgttttcattgccactgccccatggtatgcatttaaaacaactttattaattttattaacgttatctatcagtcattggtgtgatttcctgtgttactcaggatgtttgggaaaaagaaactccttttaccaaactgtgtttcaggcaatctcaactttggtgtctgattgaaagagaagggccaagtcaatgtattttcccaaggagggcattatgaaagataaaatatctctcttacaattttcagtataatatgtttgttatcatgaatgagggtattcagccttgtttatatcccaagactttaaagagcttttccaaaacgagtcaatatgaacgcttaagaactaaaatttatggaagattaacaattgaagctttctttaaacaaaatggattttcaacactcacagtaaccaatatttcaagcatagtttcattcacacgtctatttctttctaagtagtttctcacacaaatcaaatgagaattgtgctctcaaggtgatagtgaaataaacaataccaaagtctatttatacatattgacataaaattacatactatatgtatacataaaaataagcctgaaaatagtaataacataatattagctatgtttattgggtgcttaccgtgtgccagaaactgttccatgcacttcagtacattaattcgcatcaccctcacaacaacctgaagaggtagctgtcattacttttgatttatgctccataatctgagagcaattcagaaatgcgtctatggtcagtaagccccagaatcacgatttaaactcaggcagtcgggcttcaaagttcacactatgaaacactatccaccccagcctctctctaatgcaatgtcagaagtactaaacgtcatttaaagtgcagagaaatgcctataggaattgagatggagacaagatgtcttccagcttgggggctcagggaaaaagggaagattcgaaaatggctttccttgaaaagtaggtaatgtttgggtaagcttagatgaaaaaaaggaatctcaagacaaaaaacaagatcatcgaaagacacagaagtaagctggctagctgttcattttagtaggagttgaaggtgcattgagaggtaaaataagaaataagattggaaacgagactcaggggcaattgtggagagccaggtgaaggagtctgtagaatattctgaagggctttgaagtcaaaaaaggtgtttgaagaggggagtcatatattattttcgttcactgacaaatacttattgaacacttttcatgtgacacacacagtcttggacaatggatatatacaagtgaataaagcagatgaaatctttgctctcatggaatttgcattgtagttacaacctaagctatgttttaggaagcttaatttaaatggaaatctgcaagttggattggagccactggtgggcaggaatgagtggaggagggtaaaaaatagtaagagtgtgaatgagagtggaggtaaggggctagtgagaaaggaatggtcataaagaattagggaggcagaatctacagaccttaaaaatgaacttgaaagtgaggcaagtaagtgggagatttagaaatgactatatgatctgaactctctgactgaaaagatggtaccgggatgaacagcaggataggaaataagacttggtataaaaaatggcctatttgggtcatactgaatttatgtcatttgtgagacatttgagtaagaaatgtcctacatacagtaagaaatgtgggacagacattggaaaggaataaaaatgttcaaatcattggattaaaggagatggagaaaagactgtttctagtataataactaacacataactgacagtaactattgactaaatatcaaatgaagataatgagattaatgaaatcagaaaagaatgcatagaattgatactgtgggcttggtgtggtggctcacacctgtaatctcagcgttttgggaggccggggcgggcgcatcacctgaggtcaggagtttgcgaccagcctggccaacctggtgaaaccctgtctgtactaaaaataaaaaattagccaggcatggtggaaggcgcctctaatcccagctacttgggaggctgaggcaggagaatcacttgaacccgggaggtggaggttgcagtgagccaagattgcgccattgcactccagcctgggggacaagagcgagacttcgtctcaaaaaaaaaaaaaaaaaaaaaaaaaaagtcaaaaaataccagatgctggtgaggttgtgaagaaaggggaatgcttataccctgttggtgggaatgtaaattagttcagccactgtggaaagcagtttggaaatacctctaagaactcaaaactgaactaccgttcaacccagcaatgccattactgggtatatacccaaaggaatataaatcattctaccataaagacacatgcagctgtatgttcattgctgcactattcccaataccaaagacatggaatcaacctaaatgcccatcaatggtagatcagatatagaaaatgtggtacatatacaccagggaatactgtgcagccagaaaaaagaatgagattatgttctttgcagcaacatggatggagctggaggccattatcctaggtgaaataacataggaacagaaaaccaaataccatatattctcacttataagtggagctaaacactgagtacatatgaacacaaagaagggaacaacagaaaccaggatctactctagggtggagggtgggaggatggtgaagactgagaaactacctatcaggtaccatgcttattatctgggtgacaaaataatctgttcaccaaactcccatgacatgcaatttacccatgtaacaaacctgcacatgtgcccctagagcttaaaataaaagtgaaaaaaaaaaaaagaagaaagaaagaggaaggaatgagtgcttagagagacaaggagacaattagtataatatatcaccctggcaagtcaaaaggtgagacatttttcagtaggctgtagtgagcagtaataacaaaatatgagtagatttctagggcaatgaggacttgataaaaatatttgcatttggtagttatggtgatttcatagagaagtgtttcagttgggaggcagatgtagaaacttgactttaaaatgtaaaggaaagatggatgtttaggaagtagaaatatttccactaatttctattagatgagtgatttgaagcttgcttttggtgatcttgggtctttccctgtaatgctgagtcaatgtagagtaatgggtaggacagtagagttggtagaagatcagaaagtcaaacttaggttcaaatgctgacttttctatatattcgggttgagcatcccaaatctgaaaatccaaaatccaaaaaactctaaaagctgaaaatttttgagcgccgacatgattctcaaagtaaatgctcattggagtatttccaattttgaattttggggtttgggatgcttaacccataattataaagcaagtaatccaaaatctgaaaaaatctgaaatccaaaaaaagaatcagaaaaaaattgatatccataacacttgtggtcccaagtgttttggataagggatactcaaccagtacttgtgtgttaccttagtagaagttacccagcctctcagtttttcctctgtactaaatatacgatggtattacatcatgcaagcaaagcacttagtacacaccttggcacatagtaactattttaaaaaggtagctattattattattaccccccttaataattgaaaaatacatgatgactttaatcccagaaaagtaaacatttattgtgacaagcttttagtttatataattgccctcctaactgggagtaataaaatttagtagttattttaacaagtagcaatagataaattacttaacctctccaattttattcttctcaaatgaaaatggaaataataggagtaccaacatcacaggttttcactaaggatcaaattagaaaatgacagtaaagatactttgccaattatgaaacataaaatatttagttattattctttattaattaatataactttgatccattgacttttaagagcatcctattagatttacatcttcagtttgacttttgtttaatggtaattcataaaattaataaggacctttcacttgaaagctttttcaaagtgctttcatatttattcccttataagatcctcacaaaagctctgcgaggaataaaacacaatggttattggaggctaacaaaattgacttttcagtatgcacagtgtcttcttaccaatgtgggcttttcttttggtttatagatataaaattacaaaatccaatagttaatttacaaagttattcaatttagtcattactttgtatcattctagataattgtttaatgtaatggcaacatccagaagtaggttttaaaggttttaatacaattaacatgtttacgtatgaatgagacatggttcatgttaccatggtaacatggtccaaaacggtacaacacttaaaatcaaatagctaaactcatattgcattaaattggggtgactggatgaaaaatggattctaattttctgcattcagtctttcttcctgcaggagataaaagaccagtcctgaacatttgtccccattgactcccttttctaaacttttaattattttcattatttcatttcggattttctctgagatctacaggaattcagggtcccaaaatggaaaataataaagtaactaaatatagcaagaagacaatcatgtgagtcttgagtattcctgagcattatagtcagaggttctcactgaacaatagattcatgggtagaacatgctacgttcaattgaactggtatctatcgagggtagagacagtagtattgtgaatgaggatggggtttttatagtatcaatatgagaataaaaggaaaaatgaaaatttccatgtttatataagaaaaggaactaattatcttattgaaaagagtttttcatgatcttggatacattatgcaaagacttttactttttccatgacataattttttttttttttttttgagatggagtctcactgtgtcacccaggctggagtgcaatggcacgatctcagctcactgcatcctctgcctcctacgttcaagcgattctcctgcctctgcctcccgagtagttgggattacaggcgtgtgccaccacacctggctaatttttgtatttttagtagagacggggtttcgccatgttggtcaggctggtctcgaactcccgacctcaggtgatctgcccacctcagcctcccaaagtgctgggattatatgcatgagccaccacgcctggcccatgatatgaattttatgccaaagctttgctaattctttgcctttttcacaattagtttattaagagggtccctataactgtctttttgaataacatggacaatagtatcacttaataccaattctgtactacagtaagtaacattttggtgacatttagatatatttctgagtggaccatggagaaattcaaataacgacataaatttgtgtgtaatataatttatttctatggcttccatgttgatgtccttcaattttaaatctttaacccagatctttttccaaaccttagatttacattcacaactgcttcaagagaggtaaggttttcacctctgatttttcacttacagatacctcaaaatcaaacacgttcttgactttgctcctcacaactgtttgccatcttgaattctgcaactcatgattgagtgaagacactaccttcagtcaatcatgccaagtggtaagcaggcactgatttctcattttacctcacattttctgctcacctccacctcccacaaaacatatgacagtgttgattttatctccaaatagctcacgtatctgttttgtttgttcaacctcaccactttgatcatcaattcttgcttggcttattacagaaataatgtcctaactgttgtccctgcatgggtctcatatctttccaattcattctcctaaccactaccagaatgatcttttaaaaacatgtctgattagtccatttccttgcttagaactaggctatgacttaaagtgataaaagtccagagtctgaaaaataggtggcaaggggcagagagagccagcttacacttactgagcccttcgagtccaatagtctgcctctctggtatgcattttacatatatcttatcatttaaacctgataaaatcctgtgatgtactcattgtatagaagagtaaaattgggactcagaggtcagacaataagctagtaagtgctaaataaggggtcttcctgcttacaaggtccatactctagctgctacatcatgctgtctttccacataatttagccccagttgatctaatttcatttcttgtagcaaccataccccagccaagttccttcagattctcacactaccacactgactaagcctttggatatggtgtttcctctatcacgaatgctcttttcaaccccatgaacctaaataactcctaacaattcttctaaggtgactttctctaaacagaggttctcactggacaatagattcatgggtaggacatgctatgctcaattcagttggtatctattgtgggcagagatatttttaaaatctcccccagtgcataagcaaggttaaaatccaccgttctaggtgagtttcctggcctctttggaaggtttagcctagtcttctgtttttgctagaccctgtccagctctctactgtaattctcataatgctattataattttgtcttaggatgtatgtcttcacctctggaatgtgaacctctcaaaggcagaaataatgttaaaatacagaggcttttgaatatatgttacaaagtgatccagtatttccacaccgacagacacacacacacacacacacaaatacacacacacacaaaccaccgaaccaaagttttacgaacaatattgaaacttacttaaaagtgatggactccttatttctattctattttactaatttcattcatttctatcttaaaaatatggattgatactcattaaagtgattatacaacccagtacttttactgaactgtttttgaaaagcacctttcttggggcccttatgatggaattagttcccttataacaagaggaagtgtcatcagagctctgtctctctttgctatgttaggacacagagagaaggaagccatctgcaaaccaggaagaggggccctcaccaggccctgatcttggaatcccagcctccagaactgtgagaaataagattctgttgtataagccttctttcccttacccaccccccaaaaaagaaagaaaatcatctctctgaacatgtttgtatcaccagacctaacaccacgacacatggcaggtgtttagcaaagatacgctgaattaataaaagttctcagaaaaattttatatatatatatatatatatatatatatatacacacacacacacacacacacacacacatatatgtgtatataatttttaaatatccagagcagaaggcattcatcgccaggcaaaataaaaatatcaaaattcactttcacactctttagacaacaatcaaaatagaaagattaaaaaatacatataaaactcaattcaaactaaagcaacaggaaggaatacactaaaggtttcttctccttagaattagggatccttaaattgcctctgcattctcagatagtccaagaaatacgatactccaatttattcaaggtactaattgtgctactaagattgcattctttcttctttcttcagaattaatccgtgcgccaaaattttggtgagaaacttctccaattttattttattttattttaatttatttttttgagacagagtctgctctttcaccaggctggagtgcagtggcgccatctcggctcactgcaacctccacctcctgggttcaagcaattctcctgcctcagcctcctgagtagctgggactacaggcgtactccaccacacccggctaatttttgtatttttagtagagacgggggtttcaccttgtggccaggatggtctcgatctcttgacctcgtgatccgcccgcctctgcctcccaaagtgctgggattacaggcgtgagccaccacacccaattttaataacatattagaaatcaaagatatcttaattcataggtgtactcagatgtacaattcaaactttatgaaacttgtctctctggaaatgttttattcatcagaagacaatttttataatggggggattgagaggagacgtaggtaaaacacgagattagggaagggagtgatttgaaagatatggcctgagacatgacccagatcacagatgaaggtatctcatatatttattgctccttagtttgtcttgctgagaaaaatatgttaattacaccacctttatgaacatcataaaggtcaccacatacccacacccccacattgtctttacaagctaatattacaatgatctctcaggggtacttagagaaccacttaatatttgtgaaactcttgtgaaatattcagaaagacagagtctttccattttcagttagttacccagggttttatggtagtactttgaaccatgaacagctttgtcaactcttcttaggcccaaagcagaaaatgttttggatagagaaataatccgattcaattacgaatatagtttttttatttaaaggataaatctgcaatttaaaaatcctgaaactttcacccctaaaggctttgtatggcgttctataaaaatacatttgcttaaaaattccagttagcatatcagaaataacaatatttataagaaacacccccttatcctgaagtacaaggacgacggtaaagttcttgattttagtaaggaaagtgagttacacctttttataatacgggaggaaattctaatgtctttcagagaagaattaatcatgttaattccattcagaatgtatatgctttatattacatgtatgtttaaagaatctatgaattatgattattgctgagagaataaatatcttacgaagtggctgatagacgaaagtgataggtagtctagcaagagctggagtctccatatatagaaaaacggattgacagtcttagagaaaaacacattttgtgaaggttttcaccctctctcttcattcactagcatttgtatgaagtaaatcatcactacttttggggtagacagatatatcaaaatctgttggcagagctgttgctttggctaggcatttcaaatttcctttttttttaatatatgagaactatgattgctatacagcatgaatctatgaatacaatgctaccagcttcttcaaatgaagtgaaaaagcatgccatttcacttttctcctacctacatattatagaaaattccttttgttcaaaataaaaattcatagaggaaaaaaagcaaacacttccatttagctgaaatactgaaattgcatgtaatctcttaaggtatgctgctttatttattttcaagctcggcatttccatttgttgctcttcaacaccagtttcttgactcaattcaatcagctgaaatgtgccattaacaataatcaatagtttcagtagttcaccgttttaccatgacatctccgagtctttcatcaaaagatcattatccaaccatctaactaaaaatcaggagttggctataaatgtcatttcaatccataaaatgtagtttaaaccttgggcaagtggatttatagaaaatacaatattagctgccagggaagagggaaactgtctctgttttaaaataattttggaatcttagttaaccttattatagttaagacgcaaatgttgaggttttcagaggctctatgggagttttatctggattttgagaataaatgtagtttatcactttggggttgagacagtaaaaagcccctgccttattcccaagctctctctttttctacctcgggtacactgaaagttatgtgtaatatgtgccttagctcaaagatggaaaagagtagcctgatcgacactggactttatgtgagcaacaaataaactgtggtttggttaagccactggacaaaaacgaataaatacattttcttgagtaacatgggataagctaagacattttctcagcataatttccaactgcttttgaaagagagatcagaaatctaaacataaaatatttattttccatgcttccatagtaaatatagttaggacacatggtgaatcttccctttaatgattcagaagcttgcagtttcttgagattagaaatagagataaattttcattatataatacagcagatataaatacaaattgtatagtagaaaatagacgtatttttgccctcaactagatttaaagatatgttttattaaatccctgacataaaataattttttagtcattgggttattctttatttttcaaagtaatctgctaaaaatagactaaaatagacttaatcaaagcttattatttacctaccatagctgatgggtaaaatgtaaacccatgtatttttatttatttatttatttgttttgagatgaagtctcactttgtcacccaggctggagtgcagtggcgccacctcggctcactgcaacctctgcctcctgggttcaagcgattctcccacctcagcctcccaagtagctaggattacaggcgcaggtcaccatacccagctaatttttgtatttttagtagagatggggtttcgccatgttggccaggctggtctcgaactcctgacttcaggtgatccacccacctcggcctcccaaagtgctggggttacaggcatgagccaccgcatctggccgggaaacccacatatctattaaaattctggagtagctttatcagcatttataatattttataataaaattttatttatgaaatagcctaagccaaatatattacagtggtacattgtctaaccatacatcgaagagtgagcaaaaaactctacatttgcattgcccttatattctatcacaagccatgggagatatctataaagtctgatactgttccaaacaaattacctccaaatgatcaaactaactcaacacgcattttggaggagaaagtggggtcaaagcaggatgatgaagcaagaacgataaattcaggagccatacattgccactgttacgtactctatgcaacagagcagcaaagtagatcaactatcatatcaaaaaagaaaaacaggagaaggagaacgataggagggagaggagaagaacttctgcttattatgatttgattctggaattattcaaactagaatatacttttcataatagtttaaaaatatcataatagtttcataatagtttttcataatagtttaaaaatatcaaaaaataaagttagtctaaaaaatcaatcatcttattataatgatttatatccaaattgtatttgagagactagtaaagttattatatcaagtcagaaaaaccaactatacataacaaaactccataatagttcaggaaaattatatcaggtattgagaataaactttaagagcctccttgtactacagaatatgattctcaccaagacttcatttaaacaaaactaccccacgttctgttttcactgtttatgcatatggaactttatggaaataatttttgtttctaggaaaaacaattgtctgaaaattgtttgatcattaactacgacaaattcagccatctcattcttattttcacagatcatgttaggaagaaagctacaaaatgccagattaacatttcaaaacatatttgaaagtaatgaagggaaactgattcagttagcaacgctaaataaaacagacaattcatacagatgctttccctgtaaaatattaaataaacactcaaaaatgtcaacttttaaaatttaataaaccaatccctaagttatttctctgagcaaagtttctccttgaccgaagctctggttttatatgcaaatgttttcctggtcagagcatgtactttttctaagacgagggtgttaagtggaattataaatgatgtttccttctccctctgcctctctcctccttgtccaaataccgaaatacatcaggctgtataaaagcaactattttgttttgtccctggcttgtcagttacaagtacaaatgctgagaattgttcaattggatccacaagagtgctaaagcggaaatgcctgacttacttgccattgtttcatcagctcttttactcccttggagtcttctaggagcctttccttacgggtagcatcctgtaggacattggcagttgtttcagcttctgtaagccaggcaagaaacttttccaggtccagggggaactgttgcagtaatctatgagtttcttccaaagcagcctctcgctcactcaccctgcaaaggaccaaatgttcagatgcaattattaaatatcagaatggtgcacctagtgaactccataaaaagagaaagatggaggaactaaattgtaatataccaacaatggggtgagttgttgctacagctcttcctttaagcaacaactataatattgtgcagtctatttactttcatttttatttaacttaaaggcgtttgtatgggggaaggcatgcaagaatgacaattacagatttctataaacccctctccacagaggaggtttcatatatatatgtgaaatatatatacatatatttgaacatgtgaaagttcaaagtacctttttttcaattttgtagtttttgttggtcaattttgaaagcttatttttaatatactgccaaatttgagacaaacctttatagttaaaaccctaaaatccctgtaccatgcttgtctttgatgctgctctgaggcagaaaacaaggatttgatatgcaaggagaaaagtcaagaaaatacaaacctagaatcaaaaggaaaagactagaggaaaagacaaaaagaaggggattggagggcaaaggaagaaagacttaacaagtaaagaaataacatttcatagaaactatcattttgtgcaaactatcattttgcatgacatcagttataattattgtgttagtttcatatttaactacttgatcatacaactgagaacattttccaaaataaaaatgttatgtgtaatgaaaaagagtagagttttaaaaactaggcagatctgagttcaattcccagtgttctttaccacttacgtgatatggcaagttccctctctgattctcagtttctcatctgcaatatctattgctgtgatgagaattaaaataaaaaattcctgtgaagttgagtgccccacgttatacagttatacattacagttactcaaaaacattagttccttctacccatatcccatttccccattcctgtaatattttaaaaagatgaaacaaactctttcatgacaaaaactctaaaaatgtattcatatttttgatcatatatatatatatatatatatatataaaatgcatgtattgtggatacacacacatatgccctcagcaaatatctatataataatagcttagaaaggaaaattgccttaggcagtaacagtcctatggaaaaagattcaggtaaactttgtctgcaatgaggaaattagtactctatttaaatgtcttatttgccttctattactacacaaacactttctgggattaaacataagctaaaaatggattttaaaaaattgaacacttgaatatgatacacattgcttgttaagatgtgattgtcaataattatgcaaaactgcaatttatttcagcagcaactttatcatgggatgtgcaaaccaggcaataaacaactcctgccgagccagcggcagcaaagcccccggaagagctgtttattcatcatgggtgaggtttttgctgagcacacagtcttccacagtggagtttcagtgctcatactggataaaaatcttctgtctgcattaactggtggagggtagaataggtttatgaggatgtagctactggaaaaaaggaagcattgcactaagctatttatcaactcctaaataaactttaatactgcacagctgaaaggtagtgtagggttctggttgggcaaataaattaaacctcatgtagttcaagggctaacgtggactgccggctccctgcttatctagttttcaggcaaactatcaatgcaaggagaaatatcaaaagagtcatttatctttttatgtatcatgcttgaaaaattcagaaccactgcaacaactccacgaatctcaatgctacaattgggcatacaccttacagtttgaaccatgtgtaactgctgacaattgactgggtgtgacctataaaagtggcagtttcatgcagtttgcattaagacttactccatctccagtgcaaaatttggaacagaaataagctgtcacattccagaatataaatgcagggttagacatttgacatattttctaatgtagtccaatttcaaacaaaatttaaaaatatgaaattctcccatggcagagtgaaacttagagaatgtaatattgtgcattttatcagcatcagcttcatgatgagctgcgcttgatgcatcttagctcctctatccttaaactagaaatgccgcttaccctctgcttccagagaaagtaactagtaaataactttccaagagttatttgcaaaatgcaatgcacataaatcagatgaaagagttctaccgagacaatgtgattttcagccaaatcctaccagcaagtttgctgctttgtaaattaggcccttagggaagaacagtaactctttcaggacagtaagaaaccattttcctaaatgatacccttgtggtctgaaatattgacaacatcaggctgaatattttctaatttggaaaatacgttaaaaattcgatggcaataacagcagaaaatctcctcaaatgagctcctttacgtgcctcttgaataataggtaagactgttgtttcctgcttgtgtgggggttttacggcttcaacatttctctcggaatctatgtgtgtgtacgttgaatccctaaattttaattgtgccaggtctagtctagaatgagtcaagaatacttaatttccatatctgtgcattcaacatgctctaaatgtatcatatagttttaaattttccggaaccatatgggtttaagtggcttatatgataagtaaaatgtaaaaataagaatcataaagaaaaaaaagatatgttcagaaaaaaaaccaaaggtcttgaattagatttttttttaaattcctttgtccaagttatcaaactacaggccctggagaaaatttggctgaattttacaagtaacaatgaccagatattagaaactgtaataatgctttgcaaacagaatctactgtattggttaagtacttttttacataacaaagttttataatcagctattccagctttatggtgcacaaaaatagctgagaatttgatggagtaaggaataatgtgatttcaaaaggttttcattctattcataagagcactgtgtaccattctcagtatgtaaataagggcagcatgaaacagtgttctcatagtccatggaccagcagcaccagcaacgtctgagaagttattagaaatgcaaattcccaggcctcagcctagctctactgaatcagagactctgtgggtaaaatccggcaagctgtgttttaacaagccttccaatatatgctaaagcttgagaatcacagttgccaggaaccagatttgagaacgactggcatagtagatgctaagctgggctgcccggaccccttttcaggactgaaatacttctgaccccagctgctggtagtgctactggctgacagtcctcagctgttattcctgtctgagagctggactcagctaaagagaggtgcctagcccaaagttacccactatgtccccgagacgggctgcacgtattggttgatgggagagttgtggggtataaaatcctgggtcccttgctgcaactcaggacaattctgaagggctattctaccttcagacttcagagatcctcctggggaaggctaggaaggagaggcggagggttgattgtgttgtagttgtgactgtatggtagcccagcttctccttctgcccaatcctgctccctttcctttcctccgctcacaggtgttaatcctgagagcactctccaataaaattccttcatgctaatcactttctcagaatctgctttctgggagaacttgacctcctgaattgtcatgctgaacaaggattttaaaaatatacttgcctaagaaatatatgtggtctccaaagggaacaagatggaggattctcacatgcagtaattgtgcctgaattgctactgaacttttggttgccctttaaggagacctatagataatacaggtttgcattatcatcagttacaagcaagaatctactgaaggggcggagtgttggagctataaagcttagtgcaaccctatacgtgccaaagaaagtgtttatccagagacaactgcacatgaaggtaaagaatcacagaaggcatgttttcagcatacccattttctttttaagacctgattatcaatgaagaaatcaaataagtaagttctgacctgtcattagaaccctactcccgccacacacacacaccatggtatttctgaataaatctctaagactgcattgagttgaatatcatcaatttcttatggccaacataatacataaaaaggaaaaaggaagggaaacttgttgctttccggggtaagcctaaagagcttaattattgtatacacaccattctactattagatatatggatgaaaaatactttatcggtgcattatactgtggaattgtaagtgtgtaggtataattacagaaacatattgagtatttttagaaaaaggctcaatctgatatgaaaggttattttgcccaggttatttttaaaatgtgataaattaggaacattcaaagaactcagtcttctgctaaataacactttcactatggcctggcattgttatagagtaatcacataaaatactctgaatctttccttcctagtttatttgcaatttagccactatcatttcctatgatattttaggagaaagattaaaggatcattattttgttcctttttttggtgagatataggtcagagagaccttagtagcacctggatgtaagatcaaaatgattcttgccatatcaaccgctactcatagaaccagagttaatctgaaattcaaatttcctgtaaccataacagttcctactagtttgctagtaaattgcattttgattttaaaacataactttatattgtacttgtgaggggaagctagaattttgtcacctatggatatacagcactttgtagaaaggattccttttaatctctagcaattctattagtaacgtgcactaatgagaagcaaaagctgtcaacattgcctggattagtagtccattcctagcaaaaccaactctgtggttttatctgtttttgggcaacatctacctagaaatatgactggagaagggtggtggcaatgagagaatgtttctcttttctcctctgttatgaaactgtaaggcgaggaatatatgacatcattttaatttaacttctgatgcttgcttttcatccacagcatgaagaatggcagatctaatgtacagcatggaagataatttttaaagctaacatccacataactctttatatgttttcaaacatattcagagttattctatcatcacttcataagatattttccatttttctacctaccttctttttctatgtatactcagctggatatttcattctctgccaatggctttacactcgatacagattatctttaattctgaacctcattcttatttccacatgcctaccaacatctaattcaataattcatccatgcatccattccgtacctattgtgtaccaggatctgtgcctgatgatggtgacagaaaatccaataatacatggactttggtatttaacatattcaagtttaacagagggtacagataggtaaacatttaactagagttacaatgtaattaaggctataaaccatctggagtccttcccagtagctcaaatgtaacatatatcaatctgctttcataaacttctatctcaatttgccaaacaagtgataaatgtatcttaaacatgttttactctttccatcaaaagaggtggagatcatccagcaaggctttatctcaaaatagagtgatggatgcttaacaaaagtttgcctaactaattttcataaaaataaaaaaccttttagatatacagtacaggcttttgctggtttcattttagggctggagagattgattctgagagaattgtaatgatgttcccaaggttgtatacaagttaagtggcagagctgggggtatagcccaagtcttgcattctagaaaagaagtttttgtaactctgaagacagatattggaatacactcctctctgatatattcattgtactaaaagaaagaaaggcacaaggaagattatgtcactgaatcctggtcttcattttagagcacaaatttaattttctgttattgccatatgcagggtcgttgaaacatacaaatacctacacataagggaacacatacatacaaagatattctcctacccaaactattgcagaaaagatctggctgctctttgctttaaaataaaaatccatttttaatgcaaatttgctggtttgccgttcaccaacatatgaattaacgaggttttcatcccctctctcttgaggtctggtactaaattactcaaactctccagagttaattggaaaccatgacctaaatgttcccaaagtattgctgattagttctcagaaaactcattcccatcttttgtcaccccagacaccacaggatgactttttaacatgtgcagtagcaacacactggcatgagaaatagattaatcctccaaagataaaccacagctttgaagctatctgtgtaaacttccttcactgatacagacattttattttttaaaaaaaatatacatatcacctagactttagatagtaagagagtataggcattatcaatcacgtaaggaattttgaaagacacatttcatctctcatttttttaaccttatgaatgtttttaaaatagagatttgcgaatttatcattagggaaacaaccataattatacactttccctaaaaccattagtactttcctgaaaagacctgcattaggagacagcagtagaaaatgtgttttctactttactttgcattacccgtttcatttgatttgtatttcaactcataaatcactgaaaaaaattagttgataaagaaatgtacacagtgttatgagcagatgaaatacacgtctctatacacacatatttttttctttcttgaatttttaaagagattgatactctttaagatctgcattttatatttttctgctgatacaatacgaaaaggtactatttggagaggttgaaatataatgttgggagtaatgaattacatttggtttggttaatatacagagactcaaaatatccttttgggcatttatacaactgtaagggatctttagaaaaaaatgcagttaacactacttcccagataattacacacttaaaattggtgttgacctatagttggacacatttctgttctaaataaattctcaatgatttgtataatgcgaatttttaagttggctttggttacttgcagtgataaactctttaaagatatatttcctaatgttgatagactaagcagcttttcttctctcctaaaaggatttgtttaaaatagtataaaaaccaatttaaaagatgagcctaagatcatctcttacaaacctgataagactgtgcagttatatatatcctcatccacaataacttagagaaaaacagaacaaaacaactaactgtagcttgttagttgttgatacataatattcagaagacagcaaagcaggcaggttcagttttctaatatcaaatggcaaacacacaacagattcactttaaaagaaagaagtggctaaaaacatatcaacagatgaaataaacttatagtagagtcctgtcagtggaatttggaaatacgaacaatttcataaccgctgatctaaattctgaattatgatatcgaaatatttgtgacttttattacctagtctcttactcagtactctcttgtggttaataatacacatttgaaagggcccttttagcaaagcacatgaacagacactttttaaaagaaaacatacatgcgaccaacaagcatatgaaaaaaagctcaacatcactgatcattggagaaatgcaaatcaaaaccacaaggagataccatcacataccagtcagaatggctatcactaaatagtcaaaaataacaggttctggagaaaaagcattgcttataaactgttggttatagtgtatgttatttcagtcattgtgaaaaccagtgtggagattcttcagagatcatggatggagctgcaggccattgtccttagcaaactaatgcaggaacagaaaaccaaatactgcatgttctcacttattagtgggagctaaatgatgagaacacatggacacagagaggaacaacagacgtggaagcctactggagtggggagggtgggaggagggagaggatcaagaaaaatatctaatgtgtactacgcttaatacctgggtaacaaaataatcggtacaacaaacccccatgacatgagtttacctatataacaaacctgcacacgtgctcctgaacttaaaataaaagttaagaaaaagccattttatattcaacatgtattgttatagtattttacactaaaataatgttctgcagttttcaagctcctttgacaggatccacagatagcacctcctttcatattttaaatagcttgatgaggctaatgaggcaggttgtaattatcatgaacagtttatagatgaggaacttaactttcagggaagctgggtgagttgccaaaataaatgacaaatcttgaaacaatctagtccactgtactataagacattacctctcaaggtagacttgccagtctccctgtgaagtaaatataatggatattaatatgtcactattctcaaaagccctttgttttctgttattattatatgaattaggattatggggtatgtgtgtatatatgtgtgaaaagagaaaagaaattattattcctttgcttaccatcttcatccgtcatctatgagatgtgttacaataaatactgaactttgaactcgaggtaagcttgaggatttgatttagaaagaaggcattacaggcattaatcgaatattttaattcttatgaaattatacaaagttatagtacatacaattttggccttctctaaatgataagttagtaaatgttggttaatgatacagagagtatctgaatgtctatgtattttgggatatcttttacataaaatttctaacatgaaaataaaatacttcatacattgctttactagacattttacagtgaaataaatacattttaataaaaccaactgaacgatgaattaatttgtcgaagtgacttagtttaagtagattctaaaagaattgcccttctaattgtaaacctattttaatggctcagatatgatttacaagacaagatgtgggattacaagtagcttgagctaattaaaacttatcaaaataaagatttaaagtttcttgctttcgtacttttaattaccagggtgaaaaattgcatttaaaagacctagatactttgaaatgtattgatggccttttataagatcaattaaaatttataaagaacagtcataatttaggatttatttttttcaattagaagtacaacatgaaaggaatgaatctgagggtgcatctggttttaagaatcctctgacttatgaatataccacttactatagtctggatattcatcatcgtcatcaccattcatcaaccacaacttactgtaaattatttgagggcaaagattcacaccacagttcctggcaatttaatagatactcaataaatttaattaaagtcaataaacctactaccgataaggtatacagcttctaaaaacaaggccataggctcttgttcttaaaaaacttaaaattttcttgatgtgaatttattgaataataatttatatttatatagaattttagagtttagacattgctttcacataaattatttcagttgaacctcataataatttgaaaatattatctttgttataaaaaactattgttcagttataaccaagatgtttaaaaatgagaatgagcaattctgtgcccaaaattgtgttttgctttgcaaatgtacagatattcaatctttggaatttgtatctttcatcaaattttatattagccatgaaagtgaaggggtggactattttactgggcaacacattgtatttagctgtcaatgactgagtttctgttactcttccacgaaagttaacaattttttttctgaattttcaaaatgagtgtctgcaaaaaatgttatttcaatactttctaggtgtattaaagaaatagacagcatacaaataataacttctgtcaaaattaacctgttattttggcaaatgttcagattgcctataagtttgatcctggtcttcagacatcaagtaccaaaagtgccttaaaacgcatcctgtccagacacccatttggcttctgtcacccaaaatactcctgccctccctgctttttatcacccataagtttgatgggcctcctctctgtagttctactcatgttctgtcaaaaacatccagtgtgtcagggttgagaacagaagcttgtgacatagcaccagagatcttccatcaccacctgacactggtctattaatcgacatcctttgcgtaaaatcatgaagtggcttctaagccatccaatttatcttgcatctagccagtatttctccaacttattcacaagagtataacgaaagactttgtcaaatgcccagatgaaatgcaaatagactgctgcattttacttacctacttgtctaaaagtttttcattgtaaaacattattttatctcaataatttagacaatagggatttatccctgtatgcaggtatatctgtgttgttttactaaattagctaatctcttcaataaatgggttcatatttctcttatagcctccacgtaagttgcatttagcattttaaatgtcttggacagctacaataatatctcttataatttttacataaaattcaactgcatttatcaacaactggttagggggcgattgatatagctatgtgaggggaaggagaatagatgagtgttatcaccacccttttatagagatcatgccattcaagtggtgaaaatagattataattgcagtgataatcacagaattgtaaaagactgggctagacaatctggcaggtctgaaatggtaatttcatttagtcttgtaaaaatggcaactgtatcactcagaaataggttaggtgctccgaaaatactgctatttcattaattcacaaatcagtatttgtctggaaagatatttaaccaaattatacagaccacaaaaaaaagaggcatcctagaaattgagggaggacatttgactatcacagtgattgaagagtgttactataatagcattctgtggagagggaatgaagatggtagacttcttatacaacaaagaactctcccaagtctgacagcactttggaatatcccactggacatgcatgtatgtggaaaccctgtttataaacacctaaacctggaacgtaactcaattttacacgtaaacataagatattttcctcatgattttaagacattgaatttttcagccatgcaactaactgccataacgatccaagaaaaaatttatttcatggtgttaggaattttgccaagagttgttcagcattttggaaaattacgctatggatgaccaatgcccctcatggtatttgagtctccatacaacacaatggtgtcattctgcatttgtttatactgcattgatagtctcgtgatctaaaaacttcacttgtgttccagtgtgatcctgcctgaataactgcatactacaacacatattattttattataaatgactcttatttctctttaaaatagagttacggcatcatttaaactattgcctgtataagtagggtatgttgtctacatattttggcttataatcgtaaagaaggtattacaaagtatttgttatttaaaaaagaaaagaggggtggcattgggtctgagaagtttgaaaaccaccgatacagagccactggggaatctcaagagaaagtttattatactgaaaattaatagaatttttcaggagagaatgaggatgtgtcccctccctgtgcatccaatctctgatccctagagctccatagagaatgaaatagcattttaaaaattgctctcttctacaaccagctgtgactatcggtgaaccggaggtctacttcatatacgaacctgaattaaaaacagccagcccttgagtcagttcagagcccacgttcttgattacatttgacacaataatcatcatcatatcttaagactcaaatcagcctgacagtgctcaactcagggctgcttctcccaattagctgaaaattgcagcccagctcatctcctagggaatacgtttacatttacaattttgctgtggcaaaaaggcaacaaacacgctggaaggagcaaatcagctttttaacttttacactaactattttaagtttacctaagtctggtaaacctgttttgacaagaatgacaacgaggaagctttttttgttatgattttttataactgcgcaaagtttaagataactagagtttggactagaaggggaaaacagatacacaatgtgaatatttttacaagttacttgtcaaatgaaagctttcagaagaaacagcctttctttggtaaacggtgcattaaaataatttgcaactaatagatagggacatgtaatttgaaaacaaaaagtgagtaaatgtcaaggtcctaggaaatattttccaattatatgctaacccgataactccatgtccatgtgacatagcgttattctgtgtaattctgtaaattacttctctcctatatttctgaggggtggaataaccaaggacatttttgtgcattttgtttcctcaattatgatacctttctatgcagatcagggcagtttgcacacactatgggaaaaatggaaagtgacaaggtaaccatgcttcatggtggctgtgctgaagatttgctcagataacagtgtccttatgcgctgtcttctaagcggatgacagtgcagacatggaagagaaatatgcagatgggaaaacatgaatctagaaaagtgggaaaaatactgaggagcaggagacctggaaaagtaagacaattctagagtgggctgagatagaagacatgttgtaaccactggggacaggaaaacatgtgaacaggaacatgtatataagctgacagtgtgcaagagctcacagaaagcaaatgctaacagtaatagagaaataccattgaggcagaggtagagataaaaagaaataaggagggatcggccatggtggctcacgcctgtaatcccagcactttgggaggccaaggtgggtggatcacgaggtcaggagttcaagaccagcctggccaagatggtgaaaccctgtctctactaaaaatacaaaaaaaattagcagggcgtggtggtgggtgcctgtaatcccagccactcgggaggctgagacagagaattgcttgaacccaggagggagaggttgcagtgagccaagatcgcaccactgcactacagcctgggcaagagagcgagactccgtctcaaaaaaaaaaaaaaaaaaaaaggaataaggagagaggcaaagttgaggacaggcgcactggggaaatgacagaaataacaactcagagaaaagtgagtaagtgcaacatctctttgagtcttgttattcccaaacatccctattcacccaaagattaacatttcctacaagacaccatgttatgaatatccttaactaatggatatccctcaagaagaaatatttatttttcttatagtacagttacatacatttgggaattagaatggatttttaattggtttctgatccaagttttaatcattttgcaggaaagaagccaggactcttacaacatatgaatactcatctattatgtataatatcatttaagtggattttgccccaaatctttgtggatgtgcataattgaagaaaaagataatgttattacttctcggtaaattaattgacggtttctcctttaagattggtcaacaatctgagtactatgagcaacacttcttctatagattctgttctcctttagaaaacaaaattcacgtcttctgttgtagaattaaatctttgacagttcttaatgttgagaaaaataaaaatatcctcacgaaagtcaacattctttaatattattgagaaaagagtatacattcacattttattaaaactacggtccactgctataagtgtcatgaagttaacatatacctagtaaagtttgtaaaaaataatcagaaataagctttagtgaaaaaatccacatgttgaattttgctgtttctcacattaccttaaagtgtttttccaaattctagcttagccaaatcataaggaaactgaaatagaaatcctttgagtgactactacatactttaaattatggatatcatgttgtaaaacatctggctcattcttgtgctgtcatgattttccaaaataaaacatttgctgtttagatgttgtcatttaaaaagacccttaatgattagtcaactgatttgctttagttgatttcaaagtatatgctaattgacaacattgatgatgacacaatacttaaaaatcccatacaagttgtccactgaacaatttggtcatttccttattcatttccttattaatgctcacagaagcatagttatcattttttttttagtgagtcacagaatgggaattaatttattttaatccaatgttccgttttccttattttgctctatcagttttgtgagcccaaagaaataaagttgaccacagcaaaagcagtgctggggaagaggccagtttataggataactgcaataccttttacttggaaatatgtttgaagatcacctgaaagtttaattgacacaggatgggacagcacatctaggaaaaatggatgccattcagacaatcgttcttccgattttgatctgactatctgttcgctttgcggtgtatatcaaattgttgaattaaatttcaaaaacatcacaggtctacagggaatcattagttcccccaagtactttcgagagttgactgtagctcttttacttccctgctgtaatgacaggaaacgtggtctgaatttattgctatctcccacctctcttagagaccattgttcatttcactcatccattttccttcctgaataaatgtcaataggaaaaattggttttgataaactatattttatagtttgataaactatatatgctttctttttcaccttcttattgacaacatttgtccgattatattagcaggttccaggactaagtttaacaattattgttaagagtttttgtagggaaaaatggtatttcttgtagatatattagtagttgataatttatgtaaaaatttagtgtttgtgataggcacttttttaaaacttttcatttgaaaatatgaacatcatccatttccccatctaatcatgtctttcctgaagcatatatttttaaagtagctcttaaaacttgcaacatgtgatgtagctataattattttaatctgcatgaaaaataataggataaaaattaaagtatcagtgtaattttgatgttagaactaataacattgcacatttgttttgttagtgaaatatgtgctcaaatgatataagaataatattaggtaaatatggaaaagtagttctatgaagaatacattttttaaaaatcttagttcatcaatgcagtgaaagcaaatacagaattctctagattctcccattaaattataacagtattcagaattctttcaatatatggtggaagaagcaaaagctgatattaatagaatattatgccttttctcagaaaaacattatactttcatagaatgtggactcatatatatgtatatggagaattttgttcaatgtgctcaatatctattgcagtatctggcaaagagtgagtgcttaatttttactgaagcacttaattagaaaatggcaaatatatgtcagtatcagtattttcaccatagatactttcattatatagtaatcacagtagtgcatatataactgccactgtctgattctgacttgtactttcaaagttagaataataaagctctgccaggtaacccattttcaaaagcaaactttggcaaaactttggaatacaaaaaagaagatggagagaaacttgcctttccaggaagaatggcaaagatgtggtgagatgccctcttagagccagtatgttaatacgctaataaaagtagaaaagacttactagaactatttgaaatatcaaaaagtaacacatcactgtatgtgagaaaattctcaaaaagttacagaacctaacatcatataggtgatgctgcaatgtaaaaacacacacacacacagaaaaaggagactgatagcaaatacaagaatttctgtgtcagaattaacacaaactggtgttttgagcttaggaaagtcacagactctctgtgcctcagtatccttttctctgtcataaatattttgatattgaaattggtgacttcataggttaactcagacctatagaatgtcacgttcatttagaatatgggacagcaaattgtaaagatgtctgtccacctgctactcatttggcaaacagtgcatatcccagggagcagaacccagcgcaagcaagctgtcctaccattatcaattaagggcttgaagtcaagaatgagtcccaagccactggtttgccaaggagtctgcaaaatcttgctagaactttgactttcaattctggttcttgcaactgcactattaaagaaccttggcctcttcttagagtagaccaggtccgtccaccaggaatagttgctaagagttatgggttggccagggttactctacatgagaagtgtatgggggtttactcacacacaccaagtgcttggctgggcttctggaattgcctacctgtcaggataagttttactgttaccagcagcaacctagcaactaggctaaaagtaatcactagcgtggtgtggtttataggttttgtgtgggaaaaaaatcctcaaaattatgagttacttccattctattagaatgttgatgaagacagagtgtcaaggagggttaatggcatttgtttcagggaaaagaaaaacgttattagcagatcccagcaattttaatagactctattgtctattgcctctattgttgattgccatctgctaaaatagagactttattaagtatagcttcttttactgaagatatccctgattacttcggtggatttctaaaaaatttctcctccatcctccttgtgggaagtctcaggaaaaaaaaagattcaatatgattcaaataggctctgccagagaatcaatctctatcctctctctgtctctagctagctagctaattaatcaatattcccagaaaaaagtccttaaacttctaccagaatatgaggtaagaataacagccttggaggagtcatagaaaaaaatgtctgaatagagtcaaaattcacgtaacacaaattcccttggttagcatggcaaatgtataggcttatgcctacgtgaagaattgagctaatggcactagagaatactattcaggtaactcacggtgagatgatttcccttcagtggcctggcctatatgctatgctatctatcttacaaacacttactgagtgcatgttctatgcatagtattggaccagatactgtagtgttgtataagattcttgagaaattgttttcatggtcaaacttttagaagggatgcatactgtatagattatcccttccccccatactttcataaatacacatactttgttgattcaccaagcatgcactgtaataagggtctgattactcctatgggaaagaagtctgttcgctttgatttaacttgatattacctaatcattttttcatccatagaaccctttcttgagttattacttattaagatacagtggaactagttctgccaaaaccccatttggaaaaagaaaactcccactctagatgatgagtatgtgaagatcaggatgttataccatacaaccaccaaggtatcaccaacctgttcctgaatacttctacaactttacaaggcagcctgttccatctttggacagctttataacaatattcctctctctattaagctgaaatatacgttcttaggactaggttatatgcttaaatttattcggcctaagatcccctttggctttcctttcccactgttctatcacattgtgtgttgtgtgttgtgtgtgtgtgtgtgtgtgtgtgtgtgtaaagagagaagtgaaacagaaggagattattgttgctaaaaactctatgttatctccatatttggaatgtttttggttggtgtaggcagtggttctcaaattttaatatgcatagaaataacttggaggcctgaaagcttgttaaaagttccccaagtcccatccccagagattctgatttagttggatggggtaggacctacaaatttaaatttctagtgagctcataggtgataccaatgctgccagtcagaggaccatactttgggtaacactgcggtcttgggtacactgttgctctgccaagacctcatgccctagctggttggaatattgactactaacagctcacagctgcctccctccctggaaattgccttcagctgtaggtaacaatcttactccagtctgctctttcccatggggtgacccaggaccattaactctctagtattgggttcaaaggtccagatcccttgcttcaattcagcgtgtctctaaagggccatgcaatttccagaactcccctgaaaatctgatgaggccgcaacgcactgcaggcttcactgcacttcttcgtctgtgcaatcttgcctatcttacaaccttacacatgtatctcatgggaacactcctcaacaaaccttatgcacacaactctctatcttagtctatttccagggagcccagtctaagttagatgggttttttgtttcatgtttcttttgaacccacatgtagcaccttgcatttacattacatctttcagtattcagcctaccagtccaacttgttgaaaactttttggctcctgatactcttgtctgctatatttgctatttctccctgctttgtggcattgatttgataagaatgttatctatgtcttcatccaagccactgatgaaaatattgaaaaggacagagctgagattagattaccgggaatagctgcctgaaacctccttccaaattgataggtatccattagacagcagtgaagggagcataggcctcagagttgcagatttgggatggaacaacagttccgtttaagcagaggtcaaaagctagactcacagctaaagagaacaatgccattttagcatttctattttaataggaaacttaagtatcacttatataacacatttcaacaaaacatatctcactataaaaacataaaatcataaataatcattatgaatttatgattattattcatctaatttgtcccagcatgaaaactgtatttggtcatttcatggagggttttttcgtttacacattttaaaaaagaggttgtgataaagttgaagttcaacagctaccccaacttcactaggacatttaaaatactggcaatataaaagaaaaaggcaatccatcagtaattgtatgagcggccataagtttaagcaacgtaggttattatctacaaaggtgattgaatttggttcacctgatttgctttaattgctctgtggcataaacacactgactggacacagagtgatgtaatgagtatcataattaggaatttgataaagctaagtgtgaaactgactattagaagatatttgaaacacacaactactgctttgaatggggaattgatttcctagttaatttaaataattttcatctctttctatgaatactgatgacagacggaatgaccacagcataaaacattggctggaagaatgtcactatgtacttcaagaaattatttcccccatgttttttattgaaaagataaacacctgtccatttccttcctaataaaaatgtggtaagatttttttaaatgaaaaaataaaactatctgaaaatgcttttaactgttaataaacagggagtaagtaaaataaaaataggcaaaaatatatttgcaaaaatatgatagaaggaattgctaagaatgttgagaatgattctttatttgtaaatttttgatagtttctacaataagaatcacttgtactaaaggaaagaagttatttcaaaatatagaagaaacatccaaacacagaaaaatggtagataaaataccaaaatagaaaatcaaaaaggcacaatctgggcttagaaacaagttaagtagctctgtgtttcagaaatgccacaaaaacacacagtggtgcacggggctgcagacatagggcttttggggcctgggctgggaagtaggtagcagtagccaggagttcagattctgctgggctcaagaatctataaacactcggtataagacaaaggacctgagccaggctctttgctgcaattagtcaaggatgatatcaggtttccctacggggtgaaagggagctgcaaaaaaaaaaaaaaaaaaaaaaaaaaaaaaaaaaaaaaaaaaaaaaatctgctattgatcacaacctagaactgattaaatgacatccctttttagggggaaattggaaagattagatttcataaaactcattaatacctatatgtccaaacatttttaatataagaaatcatttgaattaatgatttagagaaaggaaacagatccctgttacatactgaataaagccaaaggatcccaaaactataagatttctagaattgtgcagaaaaaaattaagtcaagtgatgattatattcatttattaaaaaaactcaactttctaaaaataaatctacctaaattctatttttattgaatgttttaaagaagtctttctgagaatgatacagatagaaataaaatgaaaatataaatataattgaaaagtaacatgatgggtattgtagctaacattaatggttcaattaaaccaaataagaaaaactttctcccatttgctttaatatttgatactgtaatattaaatttatgaacaaaaaacagtctgttggtatcctataattttttattaggaaacaatggtaagttttcgataatactattgtttttcctgggaaaactgatacataggagcatttctaagcatatattttggtgcgttggttcagcccagttcaggactgtaggactgggttagaatgaaaatggctacttggctacatcaccaggtaattttccacaccagtaaatcaccaatgacatggttccaaatgtctccctttgtgtgcaatccctgcaagctagaaacattctaattacttgaaaggagatgacataaaatgaagcaggctgttaccactatgaaccttttagatccatatggatcatgacactctctggcccggagccccaagatttcacatcatagatgttatattaccctactgtagaatgcagagaatttttttttttttttgagacaaagtcttgctctgtcgcccaggctgtagtgcagtggcacaatctcagctcacttaaacctccgaagagttcttatgcttcataatcagttgggaagatttgggtctcagcaatataaaaatgggattgtcttgtaactatacatatgactctctcctgaagagccgaaagacacattttcatactgctaagtgtacctaaaggagttgataatggattgaattttttaacataccaaatcctctcagtccttaaaatggactacaaggtacatttcgcataagaggaatttaaaatagggtattcaaaattgagagggttgaactggtggctttggggtcatttgtagctttaaatttaatttaattttaagagatggagtctcactacgtcacccaggctggagtacactggcatgatcatagctcactgcagccttgaactgaactcctaggttcaagaaatcctcttgcctcagcttcccaagtagctgggactacaaacttggcttttttttttttttttttatgttttgtagaaatggtatctcactatgttgcccaggctggtctcaaactcttggcctctagtgatcctcccacccccacctcggcctcccaaagtgctgggattatggggacatgtcccaccaggaactttaatattttaaataaaatgtgccacatatatattatgagcaggccccaatgtaataaaggttgtattttaaacaaatatcccgctagcattctatcatatttttgtacatagctttgaaggcagcaaatctttatcctttaaatttttggaaataatccaaagccattcagtgcccaacatctgatgaattgtttcattcaattacaaacaattattgagtacaattactcagcaaataaaaggtatggctataaaataatataacagtctgctgaggatcataaaacagtccttaagtagttccagaaaaggaactctaaaattatattgccaagggacggtatttgtagatacagcatataagactcttatgaagttctaatgcttgtccctctcctaaataaacaaacaaatgaacaagcaaaaatgtataacactatttgcttttcttcccaggaaaatgttttactttttcatttgtttttactttcagaaaaatttgagaatgcttttggaaacatgtcatacatgtaaatatcatgcatcaagtctcaggagggtaaaaaaaaagcactggaatcaaagggaagcaagaagattcatttcaaggaagacagatccaaggctgttgtgaatgtcaaatgagcgtaaagacttgataactggcagaatagagaaaagttggttacaatctcccagaaatctacaaaggatgaagaggctttaggatgaggtgacaatagggataaagagagggaattgtttctagagcaatttttgaagtagaattcacagaatttggaagccagtttaatacatgtgtcagtagattgggaaagagagatcaagagaaaggtagaaggtaattcttaggtttccagttttagagacaattaagttagacaattacactacactgaaaacacagaaaatttaactttcttttaggggcaagataatgcattctacttgacacattttgcagcctgtagcatatccaggtggtaatgtaggttaggtggcagaaagtacagttctggagatcaggagaagagtgtaagatggaagttgacactgaggagtcttaatgttaactgaagccaacagacaaagctactcaaaatgtgcagagagaaagaagagagacaattaagaatggaacatcaacatttaaaattgcattgaagacagagaacttgcactgatcattgttacaactcccaactttgtatcttgagctactccccataacttaagattcatatatccagctatctactccacacatctcctagatgtataataggcatttcaaatgtaacatatccacatcttcctcccaaaatatgttactcctggagccttccccatctcagtaaatgatgaccccatctttccgttgctcaggctaaaaattcttgagtcttcttgactctttctctcacacctaaatttattccattataaaatctgttgtgctctgtacccaaaatatagtagaatccaaccactcctcaccacattcacctctcccattctgatcccagccacagtcatctcttgactgaattatgacaacagtttcctaatggtctcactacttctgtttagtctattgtaacagaggagccagataagacaaaacatgtcactcctccattcaaaaccctccaataactcccatctcattcagattaaaagctaaagtccacaggcctaaaaggccaatataatcagatgccagttacccctctaaatttattgtcaactaccttcctgctcgcttgatccttttctgcctaactgatctcccttttaaggttccttcaacatgccaagaatattcctgctttggggcattttaacttattaggactctcctggactactttttcccccccaattatacatatggcccacatcctcaggtcttttagaatttgcttaaatgccaccttttcagtaagaccttttttgattaccacattttcatggcagcactcctcttccacctccctctctctctccacttgttttcctctttgttcttccacactgtgtgtatgaccatctgacacatcatgtatttaatttttatttgtcaatgtctgtcttccaacttctgcttccaagaatataagctttatgagggtagggcttttcattgctctataccaagtaccaattactgggcctacctagcacaaacttcatacaaaagtatttgttgagtaagtaaattaatttttatggtgtcgatggcagatgatattttactgagttcttactacgcactaggcattgtgccaagcacctcacaattattatatgattagagaaatgagatattcaagataatattgttctgggaaccaaggaggataaagttttgattagcagagttgaccaacaggatcaatgttaaaatatagtcaagaagatggacgaattaaaatacactaattagctattacaaagtcactgatgatcttagtaagtccttgttttcataaagtggtggtgctggggaagtgagactggagtgggtcaaagtacaactagtagctaaagaacaggaaacagtaatgccaactactgcttaaaaatgatatagtaagcagaagcaagtacagctggatagaaaaaaaatgatatactaaaaaagttctcttaggatgagggagacttgagtatgttggcctgctaaaggggaggagcaaaaagaaagaagaaattgaatatcccaaaaaaaggaaagtagaataattactaaaacaacatgttggagaatgtaaaagagatctagtgtttaactagagtagctccttgctacacacaaaatagggctcaattgttttctcttttcttgttgcaatgaagatgagaaaggacctaggaatagagaagcaaagagtgacttacaagtgccttcaaggttgtcaaagacggagaaaacaggtcaaaatgttttcagatgatcaactattaattttgatcattaaaatacaaaacagtattataaagaacagagaatactgagatgttatggaagaaaatgtgtttgtatgtatatgcatgcatatgcatatacacgtatatgtatatatgtacacacatacatgtacacacatgtacatgctgaatctttcttagaacctagagggattttttagtatctgggagcttagctaaggaacttctaggcatgtttaaccctctgatgcaaggaccatctcctctgcttgatgagtttgtacctggctagttggcagttgtggaagccctcatacagctacaagcagacaattcagagttaatgcttatttcttgtttaaagagtgatcctggaacagaaataaggaaatgaaatctcatgacagtgtcatcataaagtcatcagccagatggcagtccttgaaatctaatccttagaggcttctcacaataatttgtaatatcacatctaatattatcttattcacaaactcatatctattcacagagattgaagacaaagaaatgaacttgcagaggctcacatttctggctttatatgttatcatggactctgtaaggactacgataaggaaaacaacatattttcctacataggtcacaacaataatctatgttcagatctgggtttctaaactgtacaatttagttgagaagcagccttctcttttttccatagatagattagttccttttaagcataaatgcctatttatatttattctatataaaatggcaagtaaaaatgatcatatcaaaagccactgtagaatttgaagactcatctgatgtattaataaacttaaacagcaaaatataaacattagtttacttttttattatgtcttgaaactgcaacatggcagtgtctgatatcaaagcaaatttctttcaagtacattttatatcttatttaacattcaacagtttaaaactaaagattttattactaatttaaatattcttccaagtgtacaaaaattttgcctaggtttctccatgtgactgaaagtctcagtgcaggcaatgcattagtgtttcatagtaaaatggtgtctaacctgaactgtgagaaatgatgtaatcagaaaactttccacagaatccctcctacctaaaaagctatagttacagaactttttcaaagatatgagatactttttctccataacccaaatattgacattattaatctttcctttttaagatgagtttaatataacaacaaaagtgaaaatgccatcctgtcatagttgtagtttttgagaccaacacaaataccatggaatactacgtagccataaaaaaagaatgagatcatgtcctttgcagggacatagatggatctggaggccattgtccttatcaaactaatacaggaacaaaaaaccaaataccccatgttctcatttataagtgggagctaaatgatgagaacacatggacacgtagaggggaacaacacatgctagggactattagagtgtggagggtgggaggagcgagaggatcaggaaagtcaactaacgggtaccaggattaatacctaggtgatgaaataatctgtacaacagacccccatgacacaagtttacctatgtaacaaacctgcacatgtacccctgaacttaaaagtgaaaaaataaaaataaaaataaaaaagaaaatgtataaatagaaaaaatcaggcagaaacaagtaaatgcattacaacaagccactgtgtagagacaacactttttatttataaatagaggcaataagatttttgaagtagcacagtaaataattattataaatgtaccctaaactgcttaacccatttatgcctaaggttgcaattttttgaatttttgcaatcagaccttggtgaggaccttgaacagtagaatataaataattcccacatgcttagtattccaataatggaacactaggataaatagctaaagtgaacatagacaaagatgatctagagcaggactatcagtaaaactttctgtgattggtggttacctgatgctgggaagggtagggggtgaggggatgaacttgattcgattttgcaggctcagagatggaagggaatttgcctcacgatgaattgtgccttgagtctcacccatatctaatttatattagattgcacttttgagtttatgctgaaataagatttttggggctttggggatgaaatgaatgtattttgtctttgagaagaacaagaattttggggaaaagggggcagaatgctatggtttaatgtttttcccttcccaaacttatggtaaaatttaattgccattgcaacagtagtaaatgtgaccttgaagaggtgattaggacatgaaggctctgccttcatgaacggattagcatcattattgtgggagtgagtttcatataaggacaagtttggccccattttttctctcttttggtcttccaccttccatcatggaatcatgacacaacaagaaggcccttaccagattccagccccttgatcttggacttcgcagcctccagaactatgagccaacaaatccctgttcattataaattacccagtctgtggtattttgttacggaagcacgaaaaggactaagacaaggacaacagaagtaggttgcatttggagaaagagattggaagaaggcaaagatgagtttagctttggacctcttcaatgtgaagttcctgtgggacattaacatcgaaagaaagcagcaggatctacatgtctaaaactcaaaagatcattctcagctggaattatagatgggtagtcatcaacagactgaaactacacaagtggatgaattcttgcaaagagtacatgtgaagtgagaaaagaacagggaagaactttatagacatgagtcagaagtagcttggtgaattgcagattctgtacaggctaaaaatgtgagttggcttctaaaattctcatttactttacccataggggaagtaagtatatgcattccttagctgatagctttttggaaccaagccaaaaaatataaactggaagtcattcccatgaagaatccagagaccttgataaaacaattttttaaaaaactgagagagtggcttgggccatcaaggagcatgagaatgaagagaggggtctgtcagaaagagtagtatagatagactagatcagtgtcctcaagctctagtttcataccatgagcaagcttttttcttggccccttagtttatattacctaaactcatcaaattaatctctgactttaatttgctttccccaaaagacttctctttgagaagcagatatttcccactaagatctaatggttgactctctgataccaattgattccatgtgaataattcttcctgaacctaatctgtccctgtttaattgaacacatataagatctgtattttgagaagaaagtccaagccttgccattgagaaaaagtagttactatgagaatttttccaaatatcagctccatattcaagtttgccctttctccaccagggtctttttcatagggctccaattaaaacttcccaactttaggttgaatcttcttttccatggtcttttccatctatacacctactgtctggaattcaggattagagttgctctattccccagggtgaccagcttaaattcagcttcacaggagtttttactctctaatgtctagctcagtttcaaaatttagttggccgcttaatttccatatatcattatctcatttctcctaagacttcctactcttagttcaaaatctgttttggccccagtggtgacttttacttcttgttaaaaatcaccgagcttattttttcagtaattgatgtcatattttggaactcaattatttttcaccgtggtcttcctcatattgtacaggtgctattttttcagcttgcacaaggtaattgtacattctgcaaagggagtcatcattcaaaaaacatttactagctccctattatatcacgtggttcaggacctggggatgtatcaaatgagaaagacaaaatctctgccctcatggcatttagattaatttaaaggacaaatatttaacaattagttacataatttatatttttatttatgattggaataaatgctagtgaaaaaagcactagagatcaagagaggtataataaggatacaaggcttagtttgaggagatactgtctataagcgctgttaatttccattcatatataatgggaaatgaagtgacgagtcatattgccctccacaaattttcccattgggtgtgtggagtgagatactaggatgagaccatgtacagctataactctatcatgaatcccaaagtgacttatttatcagataacaggtaaggcagtgtgcgccatgatgagatagaaagatattcctttggatagagttatcaaagtagactgataaatggctcttctagctataaatcagtattttgctttttgtttaatctcttggttatgtcactacttttgtgacagcgggcaaatgagatcttatgttcctcgtttttaaaatagaagtctgagccaagtccgtgagtttagttggtatttatcgtcttgaaccctcccaagctccagtttagctggattggaaaaacaaatcctcatggtccatccagtttcaccaccccattattacagccaacagtagttttagaaataatgtaattcataccttttatgaatgcttctccaagaggcattgatattctctgttatcatgtggacttttctggtatcatctgcagaataatcccggagaagtttcagggccaagtcatttgccacatctacatttgtctgccactggcggaggtctttggccaactgctatagatttttatgagaaagagaatgaatgtcagttttttttatgaaatctctagttggagtgtcttaaaatacttcgtaaacagcttctgaatcctcaggtcagaatacatatattagattgcttttaacctaccatatgatttagtcaatcatgacagtataaggtaacccacctttcaggacaaacttttcaaatgcagcatcttgagcaataaccagtatcaagtatttcaacttagtagcaattaattggcaataaagtgggcttaattgtttttatcacaagagaaaaaaactacaaaaataagctcatatataattgttgaatatgtgacatataacaacatttgaacgaaaaaaacctcatacatttctttccctcttcattaacttgttgaattgtttatgtaattagtgccatctactggcgttcaactaaacctgcatacagaaaatattgaacaacaaaagaatagtactgttattctagtcacgaattttttgaaggatcaaaatacttttagaataccttactttaaaattagaaaaaaagtcaaaatataagaatcttactaaaccaaatcacctacattttcttcgttgtttgtctttggcaattcagtgttttcaaacttgctatctcatcacttgaaacatatttcaaagaaagaagtcaattaatggtaggttttatctcgaagcatatcaacctgaaatttctattaaacatttctgcaagtgcagagaggaggcttctaagcattaagataatactaattgttaagatagttatatcaaattcaataggatgggttaagtcattgataaatggacacaggaataggaacaggtagttcaaacaagagaaagagtgggatgattttatttaaaaagaaaaaagttaactttcaagtaataaaaaatagagtattaaattgaaaaggtacaattggacaccaattaaattaacaaaaaataaaatccaaagctgaaaagaccagtaaaactagcacattcacgtattactgctggggaccgttatctattaggacaatttggcaatagataccaagtgacatacaaatgcttattcccattgactcaataatctcacttttggtactttatcctgataaaatcttcaaaagaagatcaatatactatatgacttaaaatcttcattaaccaaagcagtaaaaaaatgagaaacaggccgggtgcggtggctcatgcctgtaatcccagcacttagggaggccaaggcgggtggatcacgaggtcaggagttcaagaccagtctggccaagatggtgaaacaccgtctctactaaaaatataaaaattagccgggtgtgctggtaggctcctgtaatcccagctactcgggaggctgaggcagagaattgcttgaacccaggagatggaagttgcagtgagccaagatcacgccactgcactccagcctgggcgacagagtgagactccatctcggaaaaaaaaaaaaaaaaaaaaaaaaaaaaagagaaacaatgtcgatgtttaatgcagggacattaaaagaacataatacatcattccaatggtccaatatgtagcaaatgtgcacagtaatcactgtaaaaagagcacaattttcttgtgtaaaaaacagaacacaatttttaactacactgtgtttatctctaagaatacataatcatgagctgaacacgaaatggaagaaattgaaaataatgcttctgaggagaaaaatcatttttgttttaatatttgttcttttgcgttagtatgatatttacagaataaaaatcaaacagtgttcttagcataatttcagcgtgtttggtgaactcctattgaacatatacaatctatatataatgtaatttctcagttaactaaaacatcctagaatcaaaccaagtaatagtatttactgcatatagcaaatagacccagattaccaaactattatcaagaagctaatgccaatatcactgacttttgctatgaaagcagaggacagtgtctaaaggcacagagcatagttgctgctattacaaaacaattaacatttatccgcgtggaatgcctgccttttcttccatactccttttatcaagcattacagtttctattctccacttttcagatcctcgcactatttgaaagcccttctgagggaacttctgccaaaggcttgccttttctagaaatatcctagggtacaaaattaccacttctttctttctcctcctcacttaagccaaacctaaagtgataaaagaaatgtattccaagatacgaaagaacatgtaattggcccttagtatccagagggtgctatttgcattttaaaagaagagcttattatctctcatctattaaattgctaattaatagcatgaacatccacaaaactgagaccaataacttggttacctttttttcaaatgaattccttttataaaacactgaattgttaataaaatacttatgatggaccagtatcagagcatatatgtaaaagctcaggaatacaaaataaaaacaaaatttttagtaaatatataattaaaatcatttattttactcaagcaagttaaataaccttggaagccacccatcactcataggttcctgtttgaaaagtctagatataagaggttataccatttggatggtttcatgggtatatgcacatgttctagcccatataattttatgcagtttttgtatatcaattacacttcaataaagctgttaaaattaaaaaacataaaatgcagaaggtgccaatgaatctaaaaacataatcaatagatcataaaaatgcctaaaattataaattataacatatcctagaattttccaaaatctctgaaagaaatagtaagctagagttaaatgacagatttcctactaaacaaggtagtaaagagtgaggcttgacgtcaaaccagaactttttgatgtactttaatgcttgaaaggtagaaatacgcgtgccatatatttttctgcaaaattgtattcacagcgaaagttaggactgttatacctaaggaaatcttgactgagtgctaaccctcactgaatactgcccaggttttgtgaggatgtaggattaaaaagtaaaactcccactgaccttgactgacattgagggggctcaggcccttatataaacacaaaggttctcaaaggtagccttttttttttttctcccttcttaaagacattccccacacagaatgttttccctttctcctacggtaatattctgcccgcccaccttgggttttacccaagtgtcattcacactaggaaccatgaccttgaccagctttgcctactgctgtgaaatttactactgggataactccagacctcagaaggagtgtaaattcaaaaatacaacagacttcacacacacccttttctctttctgaattccattgacaatggtgtacaccacagggaattgcttgtgtggtgatcatggtgtgtgaagaaatttaaaatactgtgagcactagcttataaaaaaagattgcctttgtatatgtgtgtgtgtgtatgtgtgtgtgtgtgtatgtgtgtgtgttttctatgaagaatataaaatgctaaatccccaaaagattgtttccccaaccaggaaagaaatgtttcacattcaaacccattatgctgctactgcactatgtgcttgatatatattcacagtatcttaggtagaaaaagtgattgtggactatgagacaacctgaattaatttcaagaattttgagtatttttttctactttaattgtttgtcttctctcatttcttttatgtgtaagaacttattttagtgatattgaccctacatggtagaaaagagaggaggaagagaaagagtagctaaaagcctgagcaatacaatgagcctgctgggtttgaatcctggcgtgatcgcttagtggcaaatgggagagttaattatcttttctgtgcctcagtttcctcctttgctaaatgggaatattaacagtatttatgtggaaatatgattaggtgggttaacttagagaattcagggagaacatttacaaaggtgcctggcgtgcccgaaggattaaataaatattaatcatcatcagcatcagcatcatcatcatcattactactgctagcacatctactactaattttaatgagtcaaactatattccccacagtgtgagccccttctgaatgcaaagcaagtagctcgctgttttatggacattgtctagaaatgctgcaactctaaaattctccctttaacttggaagataaaagcaagtgcatagctctatcattaaaattttaaggttgaatattggttaaatttccttttaaaatgtgttttgtgatattcacctacaagtaaaataaatgtttgttccgggtgaactattacttaaatttttaatgactgtgtctcaaaggaacttcaagaaaggcagtgcagagtaacgaaaggacatcttcccaggaagttttgcttgtccattgttctgcagtttgatcttaaggaagtcattaaccttgtaagtcccagttttgtcatctgtaaactaggatggggttacttgctctgaccatgcctccggcttgtcctgaagtgtcaaaatcaagcaattgctcggaaaattgtaaaacaggatcctaatatgcttatgaacaaaaagttctacatgttggatttgttatttttccttggatcctgtatttacattcatgaaccaagggattcatggaaaaatttaactctgttagctaaccaccaagaggtcgtttgctcttagatccattctctacccatttcctactccactcagtattgagatgtactaactcccataggaggtcagaatttcctgggatttcttgctagctggcttctaactaggttaagtcatgagacacactagtgggagacagaagagcatgagaaagggtgaaacaagataattatcccccttctctctctgtcttggcagtatctcctttgtctccgtttcccactggacggctgctccctctgtaattccattacctgctgtgcagaccttacattgggtgaattagcacccgatggttctggtttctgggctttggtaaaacttgtcggttccccagcccttgaggtggtaatagtttcctgaagttgctaaactctgggttgcctcactgtcctctgttgggtttgtcagctccttcattcctatggaggagccagtcctctgtattgaatttcctctgtttgaaatatcgaatgtggtttacagactaattcctgacaacacgaactgaaagaaatctcacagtaaatgatcctacctacaattccacagggggaaatttaatatatcaaacatacatttcatgaaatatcagactttacatcttgcatccttctctctagtctcagaggaagaggcgacttttctgctattggaagttgatttcaccatctgggcacccatctattctgggatcctcctccacatactccctctctctttgtgtgttccaacttcttgcctctctgcggggaccttctctagagacttcaaacatgagtgtctctctcatctttaaacaacaacaacaacaataatctgcactctatcattttctttcctttcacagtcacactctttagaaggcagatattcactcattatctcaacttgactacattcgtgccactctccaattcatgaaaatcaggcttctgccatcatcgttccactaaaactattctgacagaagtcactatggcaaattgaattactggccccaattctttacctctccctgtatccatgccctttgctaagtaactctgaaattcttcctacgaaagacagcatgcccttgacattgagcttggtcatgcgccttgctttgcctaatcccagtgggatattactagaagtaacacaagcagaggcttgaaatgtatttatgcagtgtggctatcccttttgcacttcaccattaccttaagacaaacatgctctggactagcctactcatctcaggaggagaatgagtgacatatggagcagagcgaccccaatcaacctgcaacatgaagaagtgccaccccacccaagctgaaaattcatgaaaggcaatatgggcttattgctatatgccactcacatttgtgaaaatagttaactgattcagttaccaaaagccaatgcctatggaaagatttaagttcttatttacttgatttatttgcagcaactggtgctgctgactattctcttctcgaagttctctgctttcttggcttccactcttttggtcgcctctgtattctctgagtgttcaagcttttttttttttttttttgcctgtcctttaaatattaatgttctccaaaattctgtctctggatcaatctgatatgttggtcctcaactggagcaggaggcagggaacatactccctgggtagttgtatcataagtttttttttttttttttttaacttttatccaaatcttctacttccattgacactaccttaatttacgtccctatcatctcttgctcaggtactaaaataatcttttttattggctccctccctccactctcaaaccacccttccacctacatacaactgcgtaaatgatctttttgtaatgcaaatagaacctcatttctcctctgtgtaaaacctttcaatggtttgctattacctgcaagacaaagtcctaacctctctctttggattacaaggccctcgaatatatgacccctacctacatattcactttcatcttttgatatcttcttcctttttgagcaattccataattgtccacatgagaatataaatgctctgaaaggttaagtgacttgttcaaggtgacatagctagtcagtgaaagagtcatcataaaaatgcaggtttctggactctcaattcaggtttcatttcaattcagttaaagaagttatgcatccatataaagaaatttaaggaaaaggactgggtttattttaactgagctttgaagaatataaaacaatcttgatgattatagcatgactggaaaattattatgtataataaagtaaggcatttctgaaaaaaagacagcagaaaaatacatagtttatttttgaaaatcactaaacaatttggtcccaagaatgaattaatgttctataaatccttattgggaaaagagaagcacaatttcttccctccttgtgtgaattaaaacgacctataaaacctctttatggatttataatagaaatgttaaaatagctgtaagaaagccatttcaaaagtaaagcctctcaccattaacttcaagactcatctattaaacctctgacattaccaaacaactctgtttcagaaggtaacactctatacagggcatactatttaagaaaatggccctcattttccggcttactgaaaatgattaatctttacaatagctttgaagactacataccaacgtcgttacttttctgtcctttcaacaatgactacaagctgagagcagactagtaaatgtgttatcggccaacccattagagttccattattttctgtcttacatggcttcatgtaatgaatttttataattaaactaatggcatacaatatatttttcccctctttactttcaggccccatttctcttccagctgctttggaataagtttcatacaaaaagaagggaggagaggtctccaagtgcttcgttaccttaatttcattatgacatttttgaaagcattctctttatctgggctctctctttaatttgctgactttattaaaaggcttaagcaatactgtaattaacaaatcacccagctaccccaggcatctgagaaaagtcagttgagagggtgtagaaatggatgggtggaaacgattccagaaacaatgccagaggacagaaccccagaaaatggcgttttttcagctccttttcagaccccatgagcatattgtggtagactgcattattgttctcaaatatccagtgccttttcacgccagaagattatacatcggcattcccattgaactcaggaatggccatgtgactggttttgtctactggtcacttccaggcagaaggctcaagaaccatgttccttgcctctatgatcatgaaagaatgtaccaagatggagataccatcagccatggtccccgagtgactaagctaagtagaatgctctcatcagtctacaacgaacatgtaacatgagtaaaatatagactattaagcctctagatttgaggttgcttattactgtagcttagcctatgctgactgacatacctattcagatatgaccttatttcacatagagtagggcaattctaatacctccagacagtcctggaccaggaccagggctagaataaactagtataatgacacataaagaacaggttctcttattaataaataggaagccacataaatgttgaggaaatgtttagaacaacaatatccctgtttttctgaactacaggtaacatctcagaatatattctataggacagaacctgcctatcttgaccataaaagaaaatagctccctatccattgtgtgatggaggctcccatctaggtagcagttatgttccacagacatggctattttttcatttctatagctggcaagcagcttcatgaaagagaaaaatggagactatgtttctaaaactgtgttcataaaacttgaaaaaataagaaaagatctgtagtcaatgacatgcagatatactttttaacataccataaaattctcccacttaaagtgcataattttctggttcttaatgtattcagggttgtgcaaccattattatgatctaatttgagaacattttatttgcccccaatgaaacccataccaattaacagtccctttctattgtctattctcctcctccttcagtctttactggatgttttatatgaatgtattgatacaatttggggtcttttgtgactggattccatcacttagcatatttttgaggttcactcatgttacagtgcatatcagtatttcatttctttttattgctaaataatattccatttttggatgtagaggacattttaaaatttattcattagctgatggacatttgggttggttctactttttggctattataaataatgctgctatgaacatctgtataaaggttttctgtgtacatatgtatttttatttctgttcagcatacacctgggagtagaatggttttgtcatatggtagcttcatgtttaatatttccaggagactgggaagggtagtggtagggggaaagggggggatggctaatgggtagtgaaatttataatacaaaaatatagtttgatagaatgaataagatctagtatttgatagcacaagaggatgactacagtcaaaaaatttattgtgaatttaaaaataactgattattattagattgtcgtttgtaacagaaaagataattgcttgaggtgagggataggccaggtaccccaatgtgactgttacacattgtatgcctatatcaaaatatttcctgtatcccataaatatatatacctactgtgtacccacaaaaattaaaaattaaaaaaatatttccaggaacttccaaactgttttcaaagttgtttcaccattttacatttccaccagtaatgtgaaaattccaagcattcttcatcttctcaacacttgttattgtctgtattttttgtattagccatcctagtgggtaaaaagtactatctccttgtggttttcatttgcattttttaaacaatcaatgatgttaaccatcttttcatgtgcttatggagatctatacatctactttggagaaatgcctattcaaactgtttcttcacttgtaattaagtcatttatcctttttgttgttgaattatgagtttttatatattcttgatacaagtatcttatcaaatatatgatttacaaatatttttacccattctgaggattgtcttttccctttctttacaatattgcttgcagtacaaaagttttaattttgttaaagtccaaattgtgtatttttcggttacttttgcttttggtgtcatatctaagaaaacactgcataatccattgtattcctacattttcttagaagagttttaaagttttagttcttattaatatatttagctctatgattcattaaaaatatattattattataaagtttattttacaaaagttttaaaacattttatttttaattttattttgctttgacaaataattatatacatttatggggtacatgtatgttctgatatatgtatacactgtggaatgattatatcgagcaatttaacgtatctatcactgcatatatttatcatattttatagcaagaacatttaaaatctgttattttagcaattttgaaatatacaatataatattattaactatggtcaccaggttgtgtcataaagtctcaaaaacttattcctcctgactaaagtttttaaccccttttgatcaacatctccccattttccacccctaaatccacagcctctggtaaccaccattctactctctacttcaatgagtttgacttttttagattccacacataagtgagatcacgcagtatttgactttctgtgcctggcttatttcatttagtataatgtcctccaggttcatccacgctgtcataaacaaaaggatattctttatttaaggctgaataatactccattgtgtatatgtaccacattttctttatccattcatccactgatggaaacttaggttgattccatatcatggcttttgtgactaatgctgcaataaacacaggagtgaagatatctctttgacatactggtttaaattcttttggatatatacccggaagtgggattgctggatcctatggtaattctgttttcagttttttgaggagctaccatactgttctccataatggttgtactaatatacattcccaccaatgatatacaagtgttaccttttttccatatccttgatcaacacttgttatcattcttctctttttataacagccattctaacaggtgtaaggtgacatctcactgcgattgtaatatgcatttccccaatgattagtgatgttgagcatttttcacaaacccgttagctatttgtacatcttcttttgagaaatgtttaagtgttttgcccattttaatcagattatttgttttcttttatgatacatttaagctaatttttgtgtatggtgtgaggtggggccaaatttcattatttttcatgtgtatatccagttattctagcaccaggttgtgaaagactattctttttccattgaattctcttggtacccttgtcaaaaatcagttgaccataaatgcaaaggtttacttttgaactttcaattctatttcattgatctatatgtctattcacattctagtaccacattgacttaataattgtagctttgtagtagtttttgaaattggaaagttaactcctccaatgttgttcttttttcaaggttgttttgactattctacatcccttgcatttcaatagaaatggtaggatccacttgtcaatttctgaaaaaaaaaaaaaagccagttgtgattttgataatgattccatagagtctgtagatcaattggggggatattgatatcttaataatattaagtcttttgatctgagaacatgtgatatttttctatttttttatctttaatttctttcaacactgctttgtattcttcagtatacaagccttgcatctcttttattcctaagtttttaacattttttgatgccattgtaaatattttcttaatttcacttttagattattcatttttaatgtataaaataattcattttgtatattgatcttgtatcctacaaatttgctgaattattttattatttctaatattttttcatagattcttcaaaattttctaattacaaggtcatgttgtctgcaagtagagataattttacttattcctttctaatctggatgtcttttatttatttttcttgcctaatttccctggcctgaacttccagtacaatactgaatagaagtggtgagaccaggcatccttcactatttcctgatcttaggggaaagcattcagtgtttcacaataacattagctgtggaatttttgtagctgccttttatcaggttgaggaaatcctcttctgtattcgtttcctcgggcttctgtaattaagtgtcacaatttgcgtagctgggtagacaaaactcattgtctcagacttctggaggctagatccaaaatcaagattccagcaggcccatactcctgctgaaacctgtaggggagaatttttccttgcctcttccttgcttctaatgatggccgttaatcattagttttacttgtcttgcaactgtagcactttaatctctaactgtaacatcacatggtgtttttcccgtggtcagtgcctttatgtggcattcttctctctgtgtatgcctcttttcctcttcttataaaaataccatcttaacttgactgcatctgcaaagactctatttctacataaggtcacatttgcagatacctgggctcaggcttttagtatgtcttttgggagcgggggacactattcaatccacaaaaccttctttttttttttttttttagacggagtctcgctctttcgcccaggccggactgcagtgctgctgtctcggctcactgcaaactctgcctccagggttcgcgccattctcctgcctcagcctcctgagtagctgggactacaggcgcccgccaccgtgcccagctaattttttgtatttttagcagagacggggttttaccgtgttagccaggatggtctcaatctcctgacctcgtgatccaactgcctcggcctcccaaagtgctgggattacaggcgtgagccaccacacctggccaataccttctattcttcatttgttaagtgttctttatttttcaagcttgaaagggttttgtactttgtcacatgaattttctatatttattgtgatgaccatacgatttttgtcctttattctattgatatggtataatacattgattaaattttggatgttaaaccaaccttacattcctgtgataaatcttacctggttatggtagcaatcatgttaatatgttgttgtattaggtttgataattttttgaggcgtttcaagtctatattcataaggcatattgctctgtagcttgttttcttgtgatatctttgtctggttaggaagtgttcctttctcttctattttttggaagagttgtttatatgtttggtagaattcatcgggggaagacttctgggcctgagcctttcattgggagaagtttttaataccaattcaatttcttgttataggtctatccaggttatctatttgtttagttgttcataatatcctcttttacttctttttatttctgtaatgttggtagtaatgcaccctctttttctctaatattagtaatttgaccatttctttcctaaccaatcagctaaaactttgtcaattttgttgaccttttcaaataactaaatttctagattttggttttgttgattttttctattatattttcttcctctatctgatttttttcacactaattgttattacttcctgctgcttactgtagatttacttttctcttctttttctagtttcttaaggtagaagcttaggctactgatttcagatctttttcctttttaaatataggtatttatagttatacattttactctaagcactgcttcagcctcctcccataagttttggtatattgtatttttatttccatttatctcaagatatttttgtattttcttatttcttctttgtcccattggctatttaagagtgtgttgtataattttctcatatttatgaactcccaaatttacatctgttactgatttttaattgtactccattatggtcataaaatctgcattgtatgattttaatccctttgaatgtagtgagacttattttatgacctagcatatggcctaccctagagaatatttcgtgtacagttgaaaagaatgagtattctgctattattggatgaaacgctgtatagatatctgttaggtcttgtaagtttatagtctttatagtctttttcaagtgtctatttccttgttaatttgcctagttcttttacctgttattaaaagtgagatgttgaagtctccaactatttttgttgaattacctaattcttctttcagttcagtcagtttttgctttctgtatttccttaatattttttctttcttttctttggattggattatcccatttacctattttcaagtttgctgattctttcttttgcagcttgaatctgacgtcaagtgaaaatttaattttagttattgtgctttccaactccagatattccactgagttcttatttacaatttctatctctttattgatactctctatttgttaagacaagcacatgggcttctagatcccgcaagaacatgtcagaggttgccaaaatcccctatggacacctcattctccagagcttcactggaagtttttctccagacctatgtttatctcaactagcatcacagccttaggaacctgttatgttaaagaattgctgctaattggtttggaccaacaccctggagctagggcttttcctagaaagttatctctaagtcgggccaaataaaggcaaggccatgtatataggtttattccagggagctgcaagataggtcaaacagtggcaaggttcttggaataaaattggcctttttgaagaattccaatcctggtctacactctctggtggctaaaaggctgctagttttcacagctattatggttgcaaggctactgattttcaaggctactgtggagctgggagaaagtgacgggaaaggccaacttaaaaaacctcaaactttgccatttttattgagagtcagcatttcaaaaattgttgccagcctttggttaattcccagggttcagaaaaggcgatgtggggccaggcatgttggctcacgcctgtatcccagcactttgggaggctgaagtgggcggaacactcgaggtcaggagtttgagaccagcctggccaacatagtgaaaccctgtctctactaaaaacacgagaaatagttgggcgtggtggaatgtgcctgtagttccatctacttgggatgctgagagactcacttgatcacaggaggtggaggttgcactaagccaagatcatgccactgcactccagcctgggtgacagagtgagactccatctcaaaaaaaggaaaaaaagaaagaaaagaaaaaagaaaagatgatttcgaaaattttttgaggagcagatttacacagttaccacattatattttcaagcacgggataagttaaattgtgaaaagcaaactagagaaaatatggtacaatcaaagcataaagttattcaaggcttggtgactctgcattaaatatttatataatataatagttacctggggaaactagcccattactacctgtgttctatcagcaatgtagagagcactctgtttgtatgctttgagaactttaagagtttcatgcatactttagaaggaaaagtactattgggttattgatcttttctctttaatcacatagaagctttaggggagaacaaaagggaataaagaaaatacatgaagaaatggtaggtcctggcaagaagatttctaataatgcttttcattattgtaccagaaacccaaacctcaaactactagtgtgggtcaatttgctgatttaattttgtacaactccaaaaaatacacaaaatatataaaagaaaaattcagtttccactaccgtacatatttttatggtggatgagatatatgatgccatcgatccttccacagataactaaaaatgtaaggcactacttccatatttgaaaaatgtctccctttttagtaaaataatttgagacactcaaatagctgccttagttactacatacaataagttcaacttttaaaattaattatgtgattatagaatgtctgtgtttcaagtttcctaaagaatgccttcaaaaacacagagattttgcagccttagaaatgtttattcaataatttgaaaagtattgaatttcttgcttcagatagttttcaatattatatagccaaatcagccaggctcaaacaagatttcacttctctattgaattcatgtactcttagctcagccaagcacaaaacagctaatgctgtcacgtttgaaaagcttttacgctgaatttgacacaaaagcaatcacaaagccgacaaaaaggggatttctctttcaaaaactgacaggggaaaaaataaatgaaaactcggagcctgggaaaatctctcttgacactggaaaagaaagtttaaaacgatcaagaaataatttttccaaagaatccattgccaagtttggaccaatcttaaaagcctagggaacaggttatgaactcaaccaagaatccgccaaatgaaataaatcctatgatgatcactgttggcagttttaggtgccaatggcatactatttttgcctcttgtgaaagttctaaatggcatcatctctcataggattctgtcatagcctattggcaaagattttgattagaatgaaaatcttgtatgtttttgcctaacatctgtctttctatctcaaaagaactttattgttgtaccaggcccatagagaagataaaattaaaccatgaagccatgtggctaacaaaattaactactttctaacttcatgtttttgttttagaaaaaattaagggtgaaagaaaacaattaccaatatgttatggccgtctcttgatggcctgctaattaattgttgatactctatgccatctgcattctgttttttcaccaaatcaagactctcctgttgctgtttctttccactctgaccacgctttcaagataagctttttccacatgacatctccggttttatttctgttctgtgaataggttgttattgtccccatttattctccttatttatgtatttttgagacagagtcttgctctgtcacccaggctggagtgcagtggcgtgatcttggctcactgcaacctccgcctcccgggttcaagcgattcccctgcctcagcctcccaagtagctgggactacaggcatgcagcaccacgccaggctagtttttgtatttttagtagagacagggtttcaccatgttggtcaggccggtctcaaactcctgatctcgtgatctgcctgcctcggcctcccaaagtgctgggattacaggtatgagccaccgcgcccggcctcaccattctttttttctaaataaaaggaggagttttttctaaatgtcagaccagcaaggacataaagatggaaattaatgaaataatataaagaagttaaaataattattaaaagatgtttaacaacattgataaatatttatgcaatattaagtttacaaatcagaatttaaaatttaatttacattatgtagacaattaaaatatatgtagataagaactagaagagactgtcaataaagattagcaattatgaatcattaattgctttttggtatcaagcatttttggtaattttctttttacgttcaggtatggtgactggctcaaattttaagagttataacagtgttggtggttgggtttgaaacatttcattgttgctcagtagtgagagttagtgtagtcatcactgaggtgctgcaaaggaggctggctgctgtaatcacagctctccaaggctgtagacatagctttgtgattgccttgtgaggctcacaggctctcttgttaatcttaggcacacagactcagaaagaacttacggagcaagggggtgttgctttagccatttaatgtctcctcctgtctattttcacacttttttcctaaaagaaaattttaagtaataagccagctaatatcacttagtagtgatgacacattcgatgtaaagaccagataaccattttatttgctccctaccttttagaagaattaaacattgtcgtttcattaaaaatgaaatgcagtttgcaattattgttttattttttcatcaaagaatataatatgaaattttttttcgcagtatactatttcattgctttcattttctacctgttggtttatcagtaatgtaatataatcttatttgtcaattaataattacatgagtctttttcagattcttatggggttttcttgctttgttttagccacgtagacaattggaagaggaagcctgtgaggtcatctacaagagtaattgctatgcattcgcatcacaactctactactttcaaaagaagattctgaacttctctagccttcagttttcttctctgcaaactaagaataataagagtacttttcaaagagtgtttttgaaaggatgaaataaaccaatatatataaagtgactagcatactttttgacacacagcaagcattcactaaaagttattattaacattaggattactttaattttagcatacatcattcaagaaatggatgaaaaaattacagctttggccatctttatctgtatcgggaacttacattgaatctgcagcaatacacatcattaaattcctaaacacagagcacaaacaaaaaatgtcaatctctatagatagtggctgagccatttttatgatgtagttttagaccattccaaagcgttttttttttttaatttcaaaagtttgacaaaggatagcaattataatacaattctggttttattttaggtgattaaaacatcttacatgttttgacaatgcaattgttttgttttctactttcatatttccttctgcagatatttttgtctcttatttaaagctacttgctcttctaagagcaattaaaccctaaccattcttaccatcactttaggattttcttaggttaaatttatttctcatttgctaactaccagagtcctcttgccctagtcaaatctatcactgtatgcctctcatctctccttcttctcatctaactcaaggatccagtccaaacttcgtattttctgcttataccttcttaccagttaactactttggtttgtgatccaatagattcatagtatccgaaacttatagagaagaaaaagaagtagcataacatgctgactacctcacgaatatgactagagctttcaagaataaccacatgattctatatattacatagtcagaccaggaattaggaaaatgaccattggagattcctaattcatctatgctcatccattgaaaaaaccattagtggtaacatgtgtctcttgaaagaatttttattcacctagattttgactccaacagagctaatgataagactgtaaaattctatgtggctttctaacatcctcatcatataaactaaaaccttgtcctcatagcagctcaggtcccttcgataaaatggctatgacagagattggctaaaagctcactaattccattaactcttcctgaaattcaatcgagaacaagttctgtgtgatgggatgtggtggaagtgatatacataatttccaggcctggccataaaacaccatggattgactgaccacattctgtcttccttttctgcagtggcttttggcagtgtgttgaaaatgacaagtgtcacaaaattggaaaagtctgggtttccaagtgaccatgttgggggacagctcctaagaatggcttgtcaacctctactggactatgatataaccaagaaagcagtctttattgtgttaagctattgagatttcagagttcatttcttactatagcttagcatagcctaacctgactaatttggaaatggaagccatttcatccaagaaaatgatacggtttccttcttagatgacataaccaatttgagaatcagatactggtttagcaaaaggccttttctgtcagataaaatatctatagagggttttgatcaagtgcccaatctgatcaacctcctaccatgttacttccctgctcaaaataccctaaagcttaaccattgtttaacatttaagggcttttcaaactgactagtaaatactaagtttgaagggattaaacgcatgcaaagcactatgcatgctgcttgataaaacatagttattaagcaattttcttccttttcctttttcttttatcctgaggaattatagactactaagcagacagatatttgaggaaatttcagaggaaagagaaagaagagaagaatgagctgggctggaggtaagagaatggggggagaaagtgagagtactccttattcctccccaatcctgatacccactcacccccatttcttgatccagggcctccaaataagatatgaaagagtagacctgttactttttctaggaaggaattaagcccgaatggttgacttcatgcaactacataaatacgtataccaattttgaagtgatcttaaagatggtgcaacagaaaaccagccaactatatccagattactaaacaaaattaactttaacattgacattagctgtcaattttcctctattctctaccttgactcaaaagtctactggctaggcatgctaactcatgcctgtaatcctagtgctttgggaggccaaggaaggagaattgcttgaggccaagagttcaagaacccatctctacagaaaacaaaaatttttaaaaaattagccaggcgtggtggtacacgcctggctagtagtcccagctactagggaggctgaggcaggaggactgcttgagccccagagttcaaggctcagtgagctatgattgtgccactgcactttagcctgggtgacagtgagactctgtctctaagaaaataaatatacaaagtctactgttcatttcagctttaacgtgattttctgttaataactttacattaaacatcattaaattacaatctatggtataattttatcaaatgtaaccagtattttattttaaaaaggtatctttgatactaaccttggtttctgtgattttcttttggattgcatctactgtatagggaccctccttccatgactcaagcttggctctggcctgtcctaagacctgctcagcttcttccttagcttccagccattgtgttgaatcctttaacatttcattcaactgttgcctccggttctgaaggtgttcttgtacttcatcccactgattctgaattctttcaactagaataaaaggaaaaataaatatatagtagtaaatgctagtctggaggagacattttaaatgtaacttccaaacgttatctcacatttatgttgcttatttaaaaaattattcattgtgttatggctaggatgatgaacaacaggattctttgcttttttgatggcaaatattagtttctgttaaattattttcctgaaggtgacatagaacatcaacatatatataaaattttaactcaattcttgatccctagaaccaaatatgaatcatctgttagaaaagcactacagcagaatatccatatcccctcatccttgccacttcagcacccatcagcctgatttcccagtgccagcatttcattgcctgaaggctttctgttgccacaggagtttgctttgccatccatgtgacaggctagacataccaggcaactgatgcctcccctccagctcccagaggcagcctgtatataatgactaattgtaggaattgggatattgttacactagctcccttgatgctaggggaaataactctgaggcatgtattttacaagggttccagagtttcccaagggataaagctccagtgacccacaacagcagctggcttgataatgcaccactctttactggctgccttgcctcacctgtctcatttttccactcttctactgattaatttaccccccaaataaatcacttgctcttaaaaccttttccaagggtcttctgagtgaacccaagggaagataagtgtattagaaacttcttctttttctttcttttttttttttgatggagttttgctcttgtaacccaggctggagtgcaatggtgcaatctccgctcactgcaacctccgcctcccgggttcaagctatcctcctgtctcagcctcccgagtagcaggaactacaggcacgtgccatcatgcccagctaattttttttttttgtatttttaatagagacagggtttcaccatgttggccgggctggtctcaaactcctgacctcaggtgatccacctgcctcggcctcccaaagtgctgggattacaggcgtgagccaccgcgcctggccaacttcttttaacaatacctaagaattcacgctgggtgcattttgtaagactggcttatattgaggctatcactggtatcattggaagtccaagagggaggtactatatagattctactctgaaatatgttcttttcaaatattaaaataaacaggactacattattttttctatgcaacttctctaagctggttttatgaaataaaaataatacagaaaacaagtaataaaactgccatctactttatcccttaagcatgaaacctgatagacattctagattctttcctaagcgtcacccaacacctcatataattagttacaaatttctctcatatataacttctttcctctttctattggcactgcaaacctctatcattttttgccctcacatccataagaggctctatatcatcctcccagacccaaatctctgttttagaatgtaaattctaccccaattaaagattaaaactaacataaatctgatcactgcactccctcttataaaacccttcaatgtttccctactgtcttctggaatatcttagctggacatacgtgttcttctatgatcttgcctagataatctgagaggtttatctacaaagcaacaaatcacaagataagcagggtataagaaaccatcacagataatacaagaaccttgcaacagtagagctgttactacatctaggcccaagggatgaggggagggaaaagtggccaaaagcagagaattggaatgagaaaccaccctgagaagagcaataaccttttgtcaaaggacatagtcagcctgtggcaacctcaaagggagggaattaggagaataaatatcttgacctcactttacctcctgtcttcaatttccttctagggctcttgggtgcctaaaccaactggaagccaaagggcatgggagcccaatgatgacagaggtcagcctcccagaataaagagcaagggagagaaggtcaaagaatggctacagatggacaaacaaaatgtatatggcacaggaatataaaactatgcttcttattttgttatgtaagtaaagtcctttttaattaaccctgttgcctccacaaagttatgtgaagttataagttaaagaaatacttgagatggccaggtgcggtggctcacgcctgtaatcccaggtctctgggaggccaaagcgggtggatcatgaggtcaggagttcgagaccagcctgaccgacatgctgaaacccagtctctactaaaaatacaaaaattagcacacgcctgtaatcccagctactcaggaggctgaggcaggagaatcacttgaacccgggaggcagaggttgcagtgagccgagatcatgccgctgcactccagcctgggtgacagagcaaaactccatctcaaaaataaatacatagaaagaaatacttcagatattttgtaaataagcatcaggactagaaagaccccacaaaactagtgattgtaacatgaaatcaaaaatatagtccccagaataattaaaactcagtaagtggcacacattatagactactgtttttttatcaggtttatttctgtttgggtgtttgctatgtattgcaaaactagtcgacatattatattgcaacttcagttaacatgtcaacctctgtttaaccgtaagtctctctctaatctttgaacgccattgttttgtgtgtctcattgttgttgttccactaggtagtggaacagctttcgtagttgaggccttgtaattgtttagtcttctaattaatctttggtttataaaataaatggtgtaaatgctcttataagaaagctgtataaagtgtaaatgaaaatgtctttaagtgttctgaaatattctgtggatattccaattacaaaccctttttcaacttatcatagcaggctactttagtacacatacttgggactttttctcatatcctactgttatgtaccatgtgtatttgaaaataatacagttgacattccttaaaaatagtctctgattccaatttgccttcgctttcgttagtcttaattactaacattttactatgctagcaatattttttagaatgcctagtggttttcacataaacatagcaagctcttttgattcatgccagtaaatattttgtacatcctacagttcatttcaatagggaaaacagtctatatttttaaaaggccatctctagatattaggaaaagataaagcagttcttcctattatgtaggaagataattttaatcctggaaaaagaaggaaacttttataacctgaaccattatttcaggcaaacatgggatttgaatgcttgctcaataatagaaggctttcagcaaaaaagtggtcatatgtgtgttatgtagcaagttaaaatggctccttggggtgtgcatcccactgagggtatgctttttcacccttgaccttcaactgtacattatcataatttattagttaattaaaaatatttataggctagagactcactcaataatccatctatccctctgtgcatccccacacatccatccatgtagccagctagtctctattttatttaccatctgttagacaccagccattatgataagaacttggaaaacaaaagggtttaagacagattacctggcttctggtttaggtgcctgttagatagtggtgctattcactgcctatccaaagaatgcagagtgagcatggagaagataatgagttcagttttggacctattcactgggaggttgtgaggaacacacacataaaactaacattttagtcaggaggactgaaggatctatagcatagctgtgtattttgggagagacagaaatctgggattggccgtcactacagagaaataaaaagcaaagcctcaaatgcaagtgcattctcatttatatggcacatagactgagcccaacaccgggctgggaatggactcctggaaaatacaacgtaaaaagaataaataaaacacaaagagcaaataagatgaatgaaagactagagaaggaggaggaatatcaagaaagtgtacttttatagaacatggaaaagaaagattttcaaaaacacaagagtgattaacactttcaaatctcatagatgtcacaagacataataaaaatcataactaacatttatttgaatatctacactgtctgaagctctgtgttgttctttccttgcattaatcacttaatcatcatacaatcctataagtataattgtttacgttctttttctattgctgcaattatcctcatttaacaaatgaggaaataaagacagcgttaaataactggtctaaggtcacatagatagtgattgttagagccgacacttggattcaagaagttagacctccaaagcccatgccaaaagtatccattggctttggccacatggaattccctgaagaccatacacaaaatgatttcagtgcagtggtagaaatcttactgtaggagattaaaaaatacctatgaaaaagtaaggacagtaaattgtagactatccaaccatagatcattataagaaggaagtcagaggggagtttggtgtcaagagaagttttttcccaaatatggaaaacttgagtatgaatataggtattgattggggaaaatggtcaaaagacaaagatgatgccagatggaagaaaagtccctgagaaggtgcgtgtattgaacattaactaactacctccttctcctgtgtttcccctgttatttttccatttgtgcagttttcccacaatagacctctctttgctctgtggatggtgtgtacttagttttaactcatctccctggctttagtggttaattcaaagatggacttatggttccaagtaaggtcaatcagaaccaatgaaacaactctaggatttttgttgttgttgttgttgttcgtgattctaaaagagaaaacccattgcttcttgtttaagatggatgagaaagcacgtagttctgcagtatcctgatatccatcttagaacaattaagaggaattaaacggaacaaatactggggagcagagccatgcaatggagaaggaaaactagaatctggtcatgctatttaattcctgaatcaagcctcgtctatctttcaactgtttaatgacactgatcaatacattttgtctgagtaagtctaagctactttgaaatggattttccattactacaatgtacaagttctaacttatagagagagacaaactcttttgatgtaaacaaaggtctcctaggaattgtacaagaatcatgggaattgtacatgggaatagctttcaaatacaaaagtttaaaagaggactttgatcctgcttaaagtagctttaactagggtatctagataaatacactgaatgcttatatcaccttggaggagttcctacataaaaaatttccaaagcccatagaaccaaaacttaccaaaaatgttatggcatttagacaacattattctgtgagccttatgggtaggaagggatttttgccaccaatgtttacctctttctattcaatttctttatattatgaatacataaatgaaaatgacactcaaaaagagagacatctggggacaaaattatcccaggacattcacatatagggtggccacgcctggttacatccatggtttaaaataattctactctttttcccttttaagtagatctttgataacggaacacccactcaaatgtcatcatcacatataaagacttcccctgctctcatatgtgcagtcattttctctcaccgtggttctcccataacactttgttaagattttaaaacttgtactgtgtgctactatgatttacatttttacattttacatttctgtctctgactctagacagtgtccttgcctcaaaggcaaggacagaatctgtagaagatgctgtcagggcccatctatctgccgttggcactcatccttcaagtatatgccagcagtgtcctagtacaagcatttgccctactgcaaacctgagagattttcctcagcttgctaggtgcgctggccagaagtgctggaaagtttatgtaccaggaagcatttagccaatgatggataagagttggaatagttagccctggttccttgcctttacccccttgtggttgacaactttgaggcatgttttttgtttgtttgtttgtttactatctcccagagctccttcatcaggatcaaaccccagtggcccaaagcaataactagttccataactggcttaattattggcttctttcatttattatctcattgtcccactctcctactggtacttcctgggatcacattacaaccaaaccactttcaccattaatcattgtttaaaggtctgtttctgaaagaagctagcctaagttagtattttatccatttaaaaaaatccttctctggcaaagcggaagaagctagaaaataaaaataaagtaaaaagtaaaaattaaaaacatccttagtgcacaaactagtgtttggcatttggaataccttcaataaatgtctgtcaaatgagttgtacatgtagattatttccattatccccactttctctttataatgatataaaaatgccatttctaaagttaacctttgcccagcatcttcagtctttcttcttaagtaaccactatttgtttgttgcatttcaagttttcataatttgaaaatggactcaagactttcccatttccttccttattttcctcttatgcttatgctaatgatctctattccaggcgaacaaatgtcctctgaatttcctttgtttcttatttaatgcctttgtatcaaccacattcatttgtataaaacatctttaatgtcatgtttactagtagaatatctgtgccttatataaaatccataaattaaaagatatgggagggtcaaataattcagtaagccaaaactaatcaatgacctctctttccctaactttcttaaaataactataggttagagagaatctgttggcatatcctattgcctgtgtctatcttcttaatcaaattacagataaataatttagaaacgtccctctatatattgaagccagtggattagggtctcccacatgacctagggagacaccagctggcatggctaagggagtggttgcaccatacctcccctactcccagcagtgaagcttgcagcaacagaagtgactccttacttctcgttaaggagaagagagcgaaaagtaaagaagactttgtcttgcatcttggataccagctcagccacagtaggatggggcatgggcagagtcatgaggcccccattccaggccctagttcctggatagcatttctagacacaccctgggccaaaagggaatctgctaccttaaagggaaggactcagtcctatcaggattcatcagctactaactaaagaggccttgaacgttgaataaccagttgcaatacccagggagtacactgtgggacttggcctctgagatgtgctggcttcataggtcacccagcaaattcccagctgtggtggttatggtgaaagaccccttctgtttgagaaaagtagacagaaaagtaaaggggactttgtcttgccccttaggtaccagctcagccacagaaaggcagagaagcaggcaggcttctgggatttctgagtcctggcctaggttcttggacagcatttttggtcctgccttgggccagaggggagcccaaggccctaaaatatgggtcccagttctctcagcattcaccacaagctgatggaagagcccttgggctttaagtgaacaccagtggaggccaagcagaaccctcatggtggtgagggccacagggagaggatcctctgccttttaaaagggcaaggaagagcagggagcactttatattgtggtgtgagtgctagcttagccacaatagaatagaacatgaggtaaactgctaaggtttttgactccaatgactggccctcagacagcatctctggatatgcccggggcctaagatttccaccgaaaaatctgctgccagatgtattgaagctccactgcatgttatttgtttcctttctcttgctgcttttaggattctttctttatccttgacctgtgggagtttgattattgcatgccttgaggtagtctctgagataattctgcttggtgttctataactttgtcgtacttgaatgttggtatctttctctgtttctgaagttctctgatattgtccctttgtatcaactttctatccctatctctttctctacctcctgtttaaggccaataactcttagattgacccttttgaggctattttctggatcttgtaggcagacagcctatttgaaaatacacagccagagaagacaaaagaaaaaaataataagaaacaatgaagcatacctacaagatccagacacaaaaaacccttcaaaaaaatcaatgaatccaggagccagttttttgaaaagatcaacagaattgatagaccgctagtaagactaataaagaagaaaagagagaagaatcaaatagatgcaataaaaaatgataaaggggatatcaccaccgacaccacagaaatacaaactaccatcagagaatactataaacacctctacgcaaataaactagaaaatctagaagaaatggataaattcctgcacacatacaccttcccaagactaaaccaggaagaagttgaatccctgaatagaccaataacaggctctgaaattgaggcaataattaatagcctacaaaccaaaaaaagtccaggaccagacggattcacagccgaattctaccagaggtgcaaagaggaactggtatcattccttctaaaactattccaatcaatagaaaaagagggaatcctccctaactcattttatgaggccagcatcatcctgataccaaagcctggcagagacacaacaaaaaaagagaattttagacaaatatccctgatgaacatcgatgcaaaaatcctcaataaaatactggcaaaccgaatccagcagcacatcaaaaagcttatccaccatgatcaagtgggcttcatccctgggatgcaaggctggttcaacatacgcaaatcaataaatgtaatccagcatataaacagaaccaacgacaaaaaccacatggttatctcaatagatgcagaaaaggcccttgaccaaattcaacagcccttcatgctaaaaactctcgataaattaggtattgatgggacgtatctcaaaatagtaagagctatttatgacaaacccacagccaatatcatactgaatgggcaaaactggaagcattccctttgaaaactggcacaagacagggatgccctctctcaccactcctattcaacatagtgttggaagttctggccagggcgatcaggcaggaaaaagaaataaagggtattcaattaggaaaagaggaagtcaaattgtccctgtttgcagacgacatgattgtatatttagaaaaccccatcgtctcagcccaaaatctccttaagctgataagcaacttcagcaaagtctcaggatataaaatcaatgtgcaaaaatcacaagcattcttatacaccaataacagacaaacagagagccaaatcatgagtgaactctcattcacaattgcttcaaagagaataaaatacctacaaatacaacttacaagggatgtgaaggacctcttcaaggagaactacaaaccactgctcaaggaaataaaagaggacacaaacaaatggaagaacattccatgctcatggataggaagaatcaatatcgtgaaaatggccatactgcccaaggaaatttatagattcaatgccatccccatcaagctaccaatgactttcttcacagaattggaaaaaactactttaaagttcatatggaaccaaaaaagagcccacattgccaagacaatcctgagccaaaagaacaaagctggaggcatcacgctacctgacttcaaactatactacaaggctacggtaaccaaaacagcatggtactggtaccaaaacagagatatacaccaatggaacagaacagagctctcagaaataataccacacatctacaaccatctgatctttgacaaacctgacaaaaacaagaaatggggaaaggattccctatttaataaatggtgctgggaaaactggctagccatatgtagagagctgaaactggatcccttccttataccatatacaaaaattaattcaagatggattgaagacttaatgttagacctaaaaccataaaaaccctagaagaaaacctaggcaataccattcaggacgtaggcatgggcaaggacttcatgtctaaaacaccaaaagcaatggcaacaaaagccaaaacggacaaatgggatctaatgaaactaaagagcttctgcacagcaaaagaaactaccatcagagtgaacaggcagcctacagaatgggagaaaatttttgcaatctactcatctgacaaagggctaatatccagaatctacaaagaactcaaacaaacttacaagaaaaaacaaacaaccccatcaaaaagtgggcgaaggatatgaacagacacttctcaaaagaagacatttatgcagccaaaagacacatgaaaaaatgctcatcatcactggccatcagagaaacgcaaatcaaaaccacaatgagataccatctcacaccagttagaatggcaatcattaaaaagtcaggaaacaacaggtgctggagaggatgtggagaaataggaacactttacactgttagtgagactgtaaactagttcaaccattgtggaagtcagtgtggcgattcctcagggatctagaactagaaataccatttgacccagctatcccattactgggtatatacccaaaggattataaatcctgctgctgtaaagatacatgcacaggtatgtttattgctgcactattcacaatagcaaagacctggaaccaatccaaatgtccatcaatgatagactggattaagaaaatgtggcacatatacaccatggaatactatgcaaccataaaaaaggatgagttcacatcctttgtagggacatggatgaagctggaaatcatctttctcagcaaactatcacaaggacagaaaaccaaacaccgcatgttctcactcataggtgggaattgaacaatgagaacacctggacgcaggaaggggaacatcacacaccggggcctgtcgtggggtgaggggacgggggagggatagcattgggagatatacctaatgtaaatgacaagttaatgggtggagcataccaacacggcacatgtatagatatgtaacaaacctgcaagttgtgcacatgtaccctagaacttaaagtataattaaaaaaaaaagtaagttgtgatgttagaaacataaaatgtgggaggagggagagtcaaagtgttgagtatatgcacacaatcaaatttaagttattatcagcttataaaatgttttatgtaagcctcggagtatccacaaagcacaaacttataatacatacatgaatgataaaaacaaaagacccaaagtatactactacacaaaaccatcaaaacacaaaggaagacagcaatagaggaagaaaggaacaaagaatctgtaagacaaccaggaaacaatgaacaaaatgacactagtaagtccttacccatccatcattattttgaatgtaaatagattaaactctccaatcaaaaggcatagagtggttgagtggattaacgacaacaacaaaaaacaagacccaaatatgtgctgcctacaagtggctcatttcaccttaaaggacatgcatagactgaaagtaaagggatgaaaaaagatactccatgtacatgagaacaaaaagagagcagggtagttacacttacttcagacaaaataatctttaggtcaaatctgttcaaagtgacaaagaacatcattatatattgataaaggttatttcatcaagaggacataacaagtatataagcatcccaaatcagagcacctaaatatataaagcaaacattaagggatctgaagggaaacatagcctataacataataatagcaggcaatttcaatattccactttaagcaatagacagaaaaattcataagaaaacattggacttgaatgacattttagaccaaatggacctaacagacatatacagaacattgtgccctgaacagtaggaaaatacagattcttctcaagtacacatgtaacattctccaggatagatcatatgttaggccacagacaagtctcaacaaatttaagaaaacccatcgtgtatcttttctgaccacaatataaaattagaaatcaattacatgagaaatcatataaaattaagaaatatgtggaaactaaacaatatgctcctaaacaattattgggtcaaaagaagaaattcaagaggaaattttttaaaagtcttgagacaaacagaaatgaaaacacaacatagaaaaacttctgggggtagcaaaagcagtgctaagagggaagtttatatcaataaattcctacatcaaaaaagaagaaatatctcaaatgaaatacctaacattatacctcaggaaactacaaaaagaagaatgaattaagcccaaagttagcagaaagaagaaaataacaaagatcagagcagaaataaatgaaatagagactagagaaacaatagaaaaaaagtcaataaaactaaaagttggttttttgaaaagctaaacacaattgacaaatccttagctagactaagaatgaagagagcaggctcaaataaatcaaatcagaaatcaaagagaagacattatgactgataacacagaaatacaaaggatcctaagagactacgatgaacaattatataccaagaaattggacatcctaacagaaatggatgaattcttagaaatacataatctaccaaaactgaataatgaaaattggaaatctgaaaagaccagtaacagctaaggaaagagttaaggagattgcatcagtatttaaaagttctcacatcaaaggaaagctcaagaccagatggcttcatgggagaattctacaaacatttaaagaagacctaacacaaatctttctcaaactcttttggaaaactaaagaggaagggattcgtccaaatttattttacaaggccagcaataccctgatcccaaagccaggcaaagacactacaaggaaagaaaactataggccaatatcacgaatgaaattagatgcaaaaattctcaatgaaatactagtgaaccatatttaatagtttattagaaggattattcaccatgaccaagagggatttatccctgggatagaaggttgtttcaatatatgcaaattaataaatgtgattcaacatataacagaatgaagtacaaaaaccgtatgatcattttaataaactcagaaagagcatttgacaaaattcaacatccttttatgagaaaaactcttagcaaattaggtatagaagaaatgttctccaaaagaataaaagccataaattacaagcccacagctaacatcatgcacaacagtaaaacgtagaaggcttttctctaagatcaggagcaagacaaagatgcccactctccccacccttgtttaacttagtactgggagtcctagccagagcaattaggcaggagaaagaaataaaaggcaaccaaactgaaaaggatgaagtaaaattgccccttcttgctgatgacataatcttatacagcaaatcctaaggactccactgaaaactgttagaattcatacacaagtttagtaaagttgcagggtacaaaatcaacttacaaaaatcagtagcgataacaattgttattgtttgtacaataacaacaaactgtctaaaatagaaattaaggaaacaatctcacttataatagcatgaaaaaatatttggagtgaatttaaccaagaaagtgaaagatctgcgtgttgaaactataagacactgacgaaagaaattgaagatgacacaaataaatggaaagatttctgtgttcataaattggaaaaattaatattgttaaacataaagcaatctaaagattcgacacaatactaacaaaatctgcatattgttctttatagaattttttttaaaaaatcctaaaatttgcatggaaccacaaaagaccctggatagccaaagctgtctttactaaaaagaataaaattggaagtatgtcactactggatttcaaaatgtattacaaagctataataatcaaaacagcatggcaagtacataaaaacagaccaatggaataagacaaagaggactaaaataaacctacacacctttgatcaattgatttttgacaaaggtagcaagaacacacaatagggagaggacagtctcttcaataaatggtattgggaaaactgaatgttcacatacagaataaaactggacccttatctcaccccttatacaagaatcaactcaaaatggattaaagccttaaatgtaatacctgaaactaaaaactacaaaaacataagagaagagctccatgacattggtctgggcagtggtttcttgcatatgacccccaaacacaatcaacacaaaaataggtaagtaagattgcatcaaactaaaaagctttgcacagcaaaggaaacaattaatggaataaagagacaacccacagattgggagaagatatttgcaaatcatacattagataaggtgctaatatccaaaatatacaaggaactcaagctactcaataacaagaaaacaaataaccctaataaaaaaatgggcaaatatatgaatagacattctcaaaagatgacaaacagcatatatatatatatatatatatatatatatatacacacacatatatgtataatactcaacatctctaatcatcaaaaaatgcaaattaaaatcacaatgagatatcacctcatatcttttggattggctattatcaaaaagttgaaagataacaagtgttcatgaggatacagagaataaggaaaccttatccactattggtagtattgtgaattagtaacggcctccataaagacagtatgaatgtttctcaaaataataaaaagagaatgaccatatgttccagaaatcccacttctgggtacatactcaaaagaaaaggagggagtgtattgaagagctatctgcactctcacattgttgtagcactgttcacaacaggcaagatttggaagcaagctaactgtccatcaacatgcgaatggatacagaaaatgtggctcatataaatgatgcggtactatttagcaataaaaaagaattatatcctgtcatttgcaacatcttggatggaactggaggtcattacattaaatgaaataagccagtcacagaacgaaaatcactgcatgttctcacttatttgtgggatctaaaaattaaaactattgaactcatggagacagaataaaaggatggttaccagaggctacaaagggtagtgtggaggtaggggataggtggggattgttagcggctacaaaaaatagttagaaagaatgagtaagacctagtatttgatagtgcaacagggggactatagtcaataataatttaattgtacattaaaaaataactaaaagtacaattacattgtttgtagcacaaaggataaatgcttgacaggatggatgcctcattctccatgatgtgcttgtttcacattacatgcctatatcaaaacacctcatgtaccccgtaaatatatatacctactatgtaccccaaaaaattaaaaataaaaaaaaaattttaaaaacctaggaaattctgtcatttggaataataaggatgagcctggaggacattaggttaagtgaaataaacttggcacagagagacacatatcatataatctcatttgtatgtgcagtttaaaaaaagttgaactcatagaaatggagagtattatggtggtgatcaaaagctgcagtggtgggtggatggaaaaatgagagacgtttatcaatgggtacaaagttccagttagacaggaggaataagttctggtgttcttttgcacagcacaggaactatagctaatattgtcatattgtatatttccaaatagctaaaaaggaggattttaaatattctcaccacaaaaatgagaagtatttgaggtgatagatatgctattagcctgatttgattattccacaatgtatatatatggattgaaacatcacaatgtaccccataatatagttgtcgactaaaaacgaaataaaatttttaaaatgaatattatttgagttgtaattccactcccaggtgtatatccaacagaaatgcatagttattaatatattcaccaaaaaccatgtactagactgttgatagcatggctatggattgcagaattgttgacagcaatttcctcatgttggaaactactcaatttctcatctatatcaacatgtgtaaatacactgtggtatcaatagaatattattcagtaagaaaagtgaacaatccacaactacatacaataatatggatgaatctcacaaacatattgttggggggaaaaatacagccacagacaagtagatatgactgttcgattccttcatataatacacaaaaacaggaaaaagtaatagaaaacttttgaagtaaggatagtagtcacccttgtgaaatgttcatgactggagaagacatgaagggggatcctgagcttctggctatattatattatgtttcttgatttggatgctatttacacagttgcattctatttatagaaattcactcttctgcatatggctagccagttctcccagcaccatttattaaatagggaatttgatttgtgaaatatattctacatacaactttggacaattcatcttttttaaaaaaggtgtcacgtgtgaaatatgtgtcattttggctgctgtgaataataaaagatgcaatcattctgctacaaacacaatacgattttgactgtacattgatgtgacaaagaacatttcagaaattcttattggacagtgaactggactagattcacagacacacatcagcacatacagacgaatcaagcagctattctgctatttaataaaagaaacaaagcagtacaattgattgttatagtagtcccaagagtagaccctgcagaaatatatacaaaagacaattttagaagttttaaatgtatttcattttgtcaaggaatgaaagcaaatctaaaatctgaagatcatcagagcgaagctgttatcctaaaagtggatcagtgtggtagtctgacatcatatagacctggtaattgtccataactgagcatcaatttatactacagaattttaccacacttgcgacacttcacccaggagactgacagatcaaaaacatattatggcaatgtatttggccactagagcccatattgttagatttacatttacaccaaattcatctgacatacaaaagtgaaataataataaagtatatgcacataaacccagacaatctgtgcatgtttgtaattgaagagctacccaatgtacacattttttttttctcacaaaggtccgtcatggaaagcttctcgactaatttgtgcagtaaatagatgttgggtaataaagggaaataaataaccaatgctaagactcaggatgacagactgagacccagcatgtgtcctgatttacgaacctccagaagtgtcaaattggaaactcagcaatcatgtcaagaaccacaatattgcagagaaagaaacagttcagttgattgaatacgaaccaatctttcacttcaagttttttagactagctatgtttaattatcgatatacattcttgactgatataaattcccacaacatctctcttagggaggaatgttatttatacacaagaaatgattaccttttgaatacacattgctacagaacaaagaacagttctgttgcaatttctgcactgactgtacagcacgagaattagaagtctgtgtaactgatttttagaaagcaactttgactagcagttagtcttgggttataaccctggattagcgatgaaatagtggatttaaatgggaaaagttgatttgccacgatctcagtttcctcaactcccaaactgaaataatgacaactgcagaaccacagaattattgtgaagataaaattcaataatgaataaaagcataaaggatcctactaaagcaaggtgctactgcttctctgtatagacaagactaaacaatgaattatagttatcaacaaacattcacgatctgctagggagtgcacactatggatctcactgatcccacagagtacgccagagttccaggtagaaaatgccaaggtgaaaggcttaaattgcaggtaaatcttttgaggtcatttgagtgagtgaagagtgacggacatgactaactgtgggcaactctaaaggaaaaatgatcccaattgcagttaagacaaagatttctaaactatttgttgggatcaggaaaaagggagaaatagcagtagactgttctccgaggctaaaaccatcaaaaaatgttaggcatgatcaagaatgaagctgaaaacaaggaaaccaccattattgtaaccttgtacaaagctaggacacaactatacctagagtaatgtaagcataactcaatgtttgacatacaaagacatataaggaactgaggaaagtccaaataataacacagattataaggaatattaagatatgtcccttctacttccacaaggcatttaaacagggttctgtggaagacctatctatagttaagctttgcaaaagaagtttcaactcaaacccacaaagaggaagaaacatatatgctaaccatgtagctagtatgaacgggcattttttttcacttagatatagaaaaggaggaatgtggttgttttacaaatagagaataaagtatctgagatgtaacagatcaaaaagctaaaaacagaggggagttattggcacataaataaatcctggccactatgatgaccaagttgctttttctctaaatcccaaaaagctagaatgcagaaacagccaagcattttggttaagttcatggaagccagacccagaacaaatgactaaattttaaaattttataatattagcctaacatttaaggttagtttggaacatggaaaagatcaacagtttagtgctattttcacactgtttactcctctattatatggggataataacaagaaaattaataatctagaaagataaaaggaaataatgtacacaaggcactgagaaaagtacctgacccctagacagctctcaattataggggcgtaaataggcaatcgtgtactttggtaacactgttggacttttctggggcttcttaaatcctgagtcataaagcaaaggaggatagattggatgatccctggagatgttttcagctctaacagtttgtgaaatacgtttcttgatgcctctgtcagagctgaaagctcaccttacaaggtttttgtgaagaactcacccagcccagtgcctagatgaacaaatgacgtatcaatagccatactgttcccctggatggacctttggtaaatttcaacttggcaatcttatggtcatatattcagtcatgctacatgtcagttaaaggaaactcaagccaacctaaaaaatgttccctcctgtctgggccaaggctatttttttgtatcttaagagaggcatgtgtcacacaggtatacccattcatcaaaactcatttcataatacacatgagatttacacattctagtctatacaaattttgccacaaacaaacaaacaaaagaaatgtgaacaaatattgagctctggttaatgacatgcatgttgaagaacttaggggtaaagggaaccgatgtcaccaacttactttgaagggcatcagaaaataataggggttggcgggtagagaaagaagtaaagtgatacaacaaaatctagagagtgggttcatgagcactcactgtacaattctttcagctttctgtgtatttgaaaaattttaaaatagaatgttagataaaatgttctctcggctgggcacggtggctcacacctgtaatcccagcactttgggaggccgaggtgaacggatcatgagatcaggagcttaagatcaacctggccaagatggtgaaaccctgtctgtactaaaaatacaaaaattagccaggcgcagtggcaggcacctgtaatcccagctactcgggaggctgaggcaggagaatcgcttgaacccgggcggcagaggttgcagtgagccgagattgcgccactgcactccagcctaggcaacatagtgagactctgtctcaaaaaaaaaaaaaaattctctcacagaaaacacaaagcagtgtattatttaagcagttttctgaatcactaacaccactttccaatgaagaaaaaaataccatctgtgggatatggaagtttaaagatactaaacagaacttatacgagtggaaatggcaaaacgttttgctcaaagtcacaatgtgtatggagaggagttggaaatggaatttaggcaggtctcttaattttctaatcaacagactgtcaaagaccagattacctccttaaaagtatgctgaatattctaatagagaaaatgagttaaccttctaaagaaagctcattctcctgttttggtaataaaacatagggaagtatgtattgcttcccatacggaaagatgagctgggtgagaggaggattgggtttttaccactggttggaggataatagattatgaaaaaatatcaacatccagtcataatgaaacatgtaagttgttttattaattaaataggtgaatgctgaaatgtgatattatttgatcacattaaaatgaataatttttttaaaaacataatgacttctcttttgggggtgttggaaactattgcttaagatgaaagcctgaagttaggagaaaagcttgatgtatatctatgcaaaaatatttcagtttatcatcttaggtcacttacaagtcacagaaaagaaactatctagatgtgataataggcctaacatatcattagatgatccatcggtccagcatctcagtcattaactaattaagtgccaaatgtagcaaataaagtactaacaactcaaaagtgttcagcaagagttcattaaagcgaagctaaaggggaccattataattctagcaccacagatttattaccatgtcaccagcatgcaatgcacacaataaaactcattcatcactgtaaatttgcacatcaaatttgatgcatttgttggaatataaatatttttaaaatcatgtagaataaaaagcatttttttctcccttagcacacactgaatttcatatctacaccttgccacttcaacttttacttgatgagtgcagaaaacggaaattaaccccgaaaaacaaagtggcctcactcttatttttacaagcatactccaccatccaactattcaagttaagaaataaaaataaatggaaaacaatttcttgaacagaaactatggctaaaaagcacaattccatacattgcttactgacagaacttttctgtatttcaattcttccttacctccttctcttcagatttaggtgtccctcctacccatgcctaattccctcgctgtactcaatgttccagtctcttccatcttctatgagaagtgattccatcttttacccctcctatgtcttcaatctccgtctacaaccatgtttattttaagaagaaaacaaccaaaaccaaccaaacaaaagacaaaagagtattatttcctttggtcctacaccccacctgcgtcccctgatggaaaccctatgtcttcctcctttgtgggagagtggcttacaccagtgctacttaaaggatggtttgtgtatgagcagcatcagcatcacctgataacttgttagaaatgcagaatctcaggctccactctagagctaatgaatcaaaatctgcattttaaaataagatttttcaggtgattacattttgagaagcaatagtctatacccactatttccacatccacacctcacatacccttctaaaccattacgttttggcttttgccactgaaattacttttgtaggtgatagcagtgaccttaaagttgctacagtattagagagtctaaagtctttatgttttcagatatcccttcagtacctgccaattgacgaaccctctttgaaaccttctcttttgattaatatggaagattccttcttggattttattctgcctatttggccactcctcactctcttaggcccattccttaaatgttgctattccctaggggtctccctttgatctttttgttttcactttacatattctctctggtgagttcatgtatgtatattgcttcatttactatctctaaaataatcagagtaaaatctgtgttttaagctaagaattgtctcttgaactctgtatccatagagccaaacgcctactaaatctctatgaaatagccaacatatccaaactggattacatcatcttcattcttcctctcccctaatcactgatacacatctgttcctctacttagtcactgaaggagaaacatgcaaattatccttcattcttctttcttccttatactttaaccaagaagatgccgagtcacttctccttaatagctcttctggcctctatatcattcatctctctcttccctagattgctttagttaaaagcctcctgatggtctctctagttcagcggaacacaaccttgtctgtgcatttgaatcaagagggctgctttaaaaactacgaatgtctgggccctattaaggctctgatttaactggtttggggtggagtccaagtattggcattttttttaaactccccctagtgattctaacgtgcagccagggatgagaaccactgatttaatgttagccttttgcactccccatccttctttaaaactctagtcagagaagtcttttttttttttttttttaatagggagtctccctctgtcatccaggctgaagtgcagtggcaccatcttggctcactgccacctctgcctcttgggttcaagctattctcctgcctcagcctcctgagtagctgggattacaggcatgcaccaccatgcccagctatttttttgtatttttagtagagatggggtttcatcaagttgaccaggctggtcttgaactcctgacatcaagtggtccacccacctccagagaagtcttctgaagatgaaaatcttggtctttcatcacttattaaatttccttaatgtcatgcctcccaccccacactgctttcaggatagtattaaaactctttacctatcctacaagatcttttataacgtggcctttgtctacttttctagtttcttggcttctgctgcctgttgtgatgcctatactccagctttacagctacacaggaaggagccctaggtatgtacaatgttaccacacacctcacatttgtctaagtatttcacatgtatctcacatgtgtctatgctttctctctgcctacaatgctctctgccttttcagtttgcagcactctgctcaaaagtcactgccactagtcagttttgtcctgataattccctttcaccctatcaaagccttgtttacgtgccattccatgctaccttgtgagtttctcaagtcataaccaagaacttaagtactcatgtaagtgtccttcctacccatgcctaaactgtaaaagtgaaaatcatcacaaatatgcaatatataaacaaaataaacacatacatttagtcaatgctatgaaaattaagtatgtgatcaaatgttttgaagagtgaaaatggggcttttgtattaaggggaagatgaggaaatgaattgatgaagtgtagcctgaactgatttcttcaaatgcttctccagaaaagcaaaaagaggaataataaaaaaaaagatcaatgaattctggttcatttaacatacatactatattattaagacaaacacaggatcagtgaaaataaaatatattttagactaaaatgctggtagaaaaaccaaaaaggaaggagtatgaaagacataagttacccttcctaggctccattttcagatatttttgattgtttaaacttcagcaattcatgaatgttatagtaaatgatttgaaaaatggggagataaaagtaattctttcctcgttccaataatccccattcaagtaacaaaacagcttaatacaaaatatgtaaatttatttttaatttttttctgatgacttatcctaaaaatctacaaaatatgtaaatgaacttttaaaattagtataggaactcttacaatagtacagcagctccttaaatgcaatgcttgggtttatgggaaacaaaaaacactctgtcaattgctcccactgttttcatttacctcctggaaaatcataactatacatccagagaagaaagacctggagagagacaataccttggtgaaacatatggctacgaaatacaggaacagaatagtataatcaccttaattttaaagggaaattctcctgaaacagaattcccatagtaaaaggaaaaaaaattgaggaatttaaaataaggtaatccatgtgaacagtgctttgtaaactgcaaaactgtcagcaaataataaggtatgattgttattttctttaaaataagatacagaatagcattttgcctatactatttgcagccaagggaagatcctatccttttaaaacatataaaactaatgctttttaacccaaacaaaaagacacacatacgttgccagaacttggtctcaagcaagactatatttttctaagttctttaataaataaagagccatttggtcattcaatactgatttgtctttatatatttgttaattatttgttcctttatgtatgcattcatcacaaacttttttataatctcttatataactgagattgagttaggatgtatacaaaatcaaagctaaaaaagaagtaataaacattctgtaagtaaattacataattgagtattcacatgcctttggaatctatgctttcacgatagactccacttattgaatgcatcactaattaaaaggaaaaactaaaaaagaaaattttcatagctcccagtggccttgtgagttatggtaaagattttggtcttcaacctcagtgcaatgggaatccactgaaaggtttaaagcagggaagtgacaccgtctaatctgggcttgaaaacattagtcatgttgctaattggagagtagattggaggggagggcaaaaaagatgcagaaaaacagagtaagatgttagcataggagtccaggcacagcctgatggtgggtggtagatggaaagataagaaaagattagtaagatttagaagataaaatgtacaggactttgcccaagttcttccctctgcctagaatgcatcatctggtacatggcaggtgcttcatgaatgcttttgatgggaaatgaacagggttataaaaacctcacaattttttaaggggtcttaggagtcttggccctgccatacttttctctcttgcaggaaaaagatgaaactaatggactgtgaccactgcttttcagcaaagtacacctaggtcactgtgcttcttccacaatacaggctgcatgtcgtgtctgaaaatcattttgcttaaagctgctttgttgggaaatattacttgcttggcttttctagcttgactttgagttatttgagataaataagtaagagagaaagttgaccctttctctatcatagtctaaaaaataaaggttgctgttggaaatcaacacggacccacaatttcttgttgaatgtggaattataattatccctcatgatgaaatgtaatatagacagtttgccatatggaatagatgaaataggtgagaggccagagctgtcagtttgagagctgtcattcatatagtgatgaataactgaagccatgagggtaaagaacaagggcaaagccttgggaatggtctgaagaggcagatcaaatgcatgaaattgaaataagacattcaggaaaggttatattattcttactttcaaggcagaagctctggagataaagcatgacaggtggtcctttgacgaagcaaagtgaacctcttgggtggtcactgatactttaccaaagtgattaggacatggctgacaagagattggatgtaaagaaaatgatagaaatgcttgtagagtttattttagctgttaaaaaaaaaaaaaaaagcaaaaccagacaggaaacttaaggaatatgagctacctcattgtggaagcaaagactcagaagaagtagagaacaagaaagtaggaggttgagtaaaatatcaggtagccaagttagtcaacaaaagtggaagatttccacttaaaatttacaaaaaaaaaatgctaaaagttagaattttggaaaacgactgaacttgaagattgtacatattagccaggcagttactctaaactcatactcttatataattattaaaaggagctcctttactaattaaatctctaacctgattttcttttttccaaatcctgccatctttttttgcttttctatcatttccacaaaaaccactcctctcctctctttcataatctctgagtttatcaacatttttttttggttacgtcagactctagttttcctatattccacggtccatttgaaagcactaacttattacatgtaactagtgccaatggaaaattccagctagcaataaacgcatctatgttagtcactgtaggcagaactaatgttggctccaatgataagaatgctcctatggttttctcttggctggcaagcagttgctatattgctcctgaaaattagaaagagttgtgctgtgaagcagtagaaattacatacactgactaatacgttagctgcaaatttctatatggattctttcaatctgaatacagtttgggtaatagctttgtccttaggtatttttgtacacacagataaagtatgttaaattttcttgagacaggcattagcaagaggttcagaacagaattagcatagttgtgttccaaaacaaaagatagctgatataaacttgccatgctgccagttccaatggtattactgaccttttaatctcgttgtttttttttaaatctttttattttttctctgctaaatctctgcctcttgctgtttaataagctaaccgttatttggaacctaatgaaaggatttttttccctcagtctaaaccttcctaaatagcctcttcattattctatttactttgaacattaaaaaaaccaaagctgaaatagctaatatgagatgttcatgaaaatctccattcagggcgtcatcatcctaattggtttataacctgctgtgctgaatagttcttccactcatcctcattttgttttgttttttaacttaaaaatgaaaagttctaccaaatatcacatgttctcacttacttataagtgggagctaagcactgagcacacatggacataaatacgggaacaatagaccctggggactactagagggaggagggaggggagtgggttaaaaaaacgacctatcagttactatgctcactaacatggcgatgggatccgtactccaaacctcagcatcatgcaatactcccacgtgacaaatctgcacatgcaccttctgtatctaaaagttgaaattaaaaaaaagaaaacttctgtgttgtgaaaaggaaccaacaatgagagaaggatataggattttaaaacatagcttcaacaatgaccccagaaacctcagaggcctttatctaactgtctgactggagaaaattatctacaaggtaccacgtgtttgcaagctttcagttcaccttttaatagccacaatggaactatgaattaaggacactaagcccgaatctccctttaattctatgtggaaggaaaagtaaagaaataaacaatgattgaaaaaaaagacttacataaaagtagatggtaaaaataaaataaaggtcaagaaggtaataaataaatcatatttcctgaatgttgttctaaattgtgttcaaatttatatgttccagacagtagaaacaaaaagcaaatccttaatgatttataaatatgtaaaagcattccatcatttgtgttattactaaaaatagatgtttatatttcagctatcctgaaaaaattagaataatattaagtaggtatatttgcacattgcctttgaaacaccagagctctattttaaaaatgtacttaatttttttctaccctaaacttactgaatcagagtcttttggctcttgaactattgcatgcattctcaacagataatgacaccccaagggagtgaaaatttgttcttgagagataaaaattcttagctatttctgagtcacaatggtttattaccctctgaaagccacaatatacgggcagatctaaagcatgtctgtggtattaaaacacggatggatataaaaggaaaaaaatcaagttcacctcaatttcatgagtgataactgcaaaccactttgatgtatttccttccagttataatttcttttgctggttttctctgttttttacaaaattaggatcctatggcataaataattccatatcctactttttttcctgagcattaatgttgtaataattccctatatcattaaatactatttgaaactacttccattaaacattttaatattcagtggtaagtataaatcaatctataataaactttctccaaaaattaatgttttaatagtattagtattataaaatgcattttagattattaatcactttccagtgataaataaccaaattacaatcttaaatgatagacactaaagtgtttagtgaccaaatttcttactcagtttccatccctgttcaaacaatgccattttatcttctgctttctctctctgctttctttcttgctcttgctctctttcttttgagaagacttttgaaatcaaactttctagaatgtctgcatatgagctagattcctacttttgcagttctaaagagagtaaaatcggctgggcgtggtggctcacacctgtaatcccagctctttgggggaacaaggcagacagatcacttgaattcaggagttcaggaccagcctgaccaacatggtgaagtcccatctctactaaaaatacaaaaattagctgggcatggtggtacatgtctgtagtctcagctactcaggaggctgaggcaggagaatcactcgaaacaggaggtggaggttgcagtgagccgagattgagccactacactctagcctgggtgacagagtgagactctgactcaatcaatcaatcaatcaatcaatcgagtcaaatcaagaaaagagtgcagagtacaaagagtttgagactaagctctaagaactgggtctttaacgaagctgtaccttttattttcacttaattttcaattgattcctttgttgcattgtttatatggcaataatgcttgttcttacacataattaccattttaatttaatctagaaaaaataataatagaatgagaaagaagataaataaaaattttttctttatctgggtcaggaattggttgttattgtacagctctctctctctctctctctctctctgtctgtgtgtgtgtgtgtgtgtgtgtgtgtgtgtggtgtgtcagagagaaatatttgcgtttggggtccttatttcatttaagtttattatgctattttcaattaatagcaagttctttacatttttaaactatattttaagagtgcacatatttcttaagagttctaaatggcatatttctatttctatgtatacatatatgtttctattatatatgtctacttctatgtctatgcacttatctgtatctatctctatctctactttgatatctctttaagtctctctttttatgtacaagttcctagaggctctaagtcctaacattccagaaatttcaaagaaactagaaagaaagattttcttctgcaattacaataggataaaagagattgtggatagtaatagctatctgcaaaaataaactggctgagcctcagatagcctggggagcttgttataaatacagattcccaaggccttcttatatccctattatgtcagaatttcttatgttggaagcaagatgtccgggaatggccagtaatactagaaatctttgtgggaaatgtcgttttgaaagggttttggggatgaagtaacccagatgaatctgggggtaacaggtagcaatgtcattaacataaagctaccaactattaacttatactaacatatctgagttttatattgttctgtgacagataataggagagtgaaggtaaagctgtatatctgtatatggtggtggttgggggaaaacctcttgcagggaatctaaaaggaagccagggagcaaacatgtgctattatgttttttgtaccatctgagatgaattgtctgtttctctgtttctattaatatttttaaggtcatctagaatagtaaagatgggtagtttatgtagcttttctcacttaaggaagcatcctttcataatgctttattacccttctcccaattctatcactttgaacaataatctatcatttggtcttctggatagtcctcactggggaggacaccccgaacacattaccattattgattttcctgccagtcttgttgtaaaataatagtttgaattattatttcttctttcaaatggtttataaaccagtgccttgtgagtttgtgtagcatgaatcagtctcccagagcctgatcatctctaggtaaactactaaaatttagttgttggctatgcaaaactgaggattggacattaaatctacgacaactctgctatatgatatgaactctatcaatgacctctttatgcagtccttcctgaaatgatttatatcatcattttttaaaaataatcattaacctgaagaaagagtatattaagatattccaaatccatgagatacatagcactttttccttgattttacccatattctaaacattcaatattaacaggcattaagaatcaagaactctttgactattgataggtcatactcaatataaaatactgtttgattggctccagaccaaaaaaaaaaaggttttgtaaaattgtgcccttttcatgtctttataaagttcctagagtttatttctgttattctcaaaatgtttcctcaggagaatttagtaatatttagatccacttaaaacaatcactagttaagtacaaattagcttccaaaatcaatctgaaaacatgctgaaaacatacatctgctaaaagatggttttctcttttatgtaccccctcccatctaaaagttattaaggaagagtctgttgctatggaaacactcgatttgacaccatctgtattcaaaattcaattgctgcaagccttcagccaatctccggtttttaattggcaagaccttcccagtatgctctacaaatctttttttttattttttatttttaggaagtcaatctatacagcatattgcaatgtaaagcatcaagaaagttcacaatgcaagcctcattccattatcttaaaatcagacttgtgaagtttcaaagcattacagccttctgataattacttggcatgaggttaatgcctaaaatttattgccaagtttttttttttgcctattggatttcacacgtaaagaaaatactcattgtaagagtgactttagtattaggaagaccctgaaaaagagccttagtgaggaacttatatcacaatacacagtttagaatggaaaacaaatatagaaatcagagttaagaatgcaattttggaatagtcagactgaagttcaatattatttggaatacttgttagctactttatgtaacctttctacatcttcttttcctcatctgtaagagatctattatgaggattttaaagtacgcattttggggactacacatacttatacatatatagtatatacatatactataacggcatttgaaaatctgttaatccacatggtcttgaagcatatttctccagaatatcaagtatctgtatataagtgttgctaaaattcatagaagagaggattacaaaaaactggaattctctgaataattatttttaaataagggaaggatatgactggatattaaagaaatgtaaatatgcttctggcaggaaaatgccaaaaaaatgtatgcacagttgtgggtccaatcacgacattttgatgggatagagaagtaattcgccacaattgagcactgctgtggtttcttgggaggctctgtcaacctactaagttatagttatcctatgggaacagaccccatagctaaagataattagaatgttgccctctggagttctgcaatgtagcaagcttgctttaccataccactgtcctactgaacagccagcctctttgataatccttaagaggtaacattccaactacactgcttattgctccaggttaccacacactttgaaaagctcatgtctttgttaattttatttaatatatttttaatttattcacttaatctagtgaatgatgtaatgattgtaatattttcgttcagtgatgactgtaatattttggttccactaaaaaactgactacattaccttcatgtgtatcctgatatgaatccctttatagtcttcctttccttttttcttaaattcataaaatgtataaattgatgaataatcaggacttatgctgtgtaagaataaagacaactttatctgcctttggttctccctttaaatctgttcaagtaggttgttctgttctgttcttgggtgaaaatatgggtaagtttcatgtcttttctggtcatcattaaggaaacaaagtcctgctccatatcgagacattaaaattagaatatccagctcaatatattaatcaatacttcaatctgaactcacatatatgatttcttcctcaattagaagaggatggaagtggacaggtcctttactacctggggtagtgggcatggtgggcttcctctttctgtcttgctagtcttctctaccattcaccagctgctatttctcaccctaacaagggttaatgggagtggaagaagaagaaggggtgcagaaaattcttacttcactcagtactgtcactgttagagtgtgactttgtgctttctaatgtcaaatatcacttctggggtttcacggagctgaaatgtatttctcccagttttaagatccagcctctgatctacttcttctatgatatgttccacaattacttcagtagacagtcagtcaacacaaactcatctgaacctactttgtgccaaacactgatctaggttctggaaaatctatgatgaaacaagacacagtccctgctctcatgcagccaaatatttttctcctttgtactttcatttttctttgcttgtacctctaatttatgctttatatccaagttattgttggtacacatttgtctttccctagattatcaacttctttagaaaatgattaacattttactcacttttataaatcccttttccaatggtcactaaagtattattaaatgaagtaatgaacaatgaataaacggatggatgtacagagcgataaatggataaatgaacaaaattataccttcatacattgttcataaaatattgtttatattactcctatgacacatatatcctatctaatattatactaattttactttttctacctaataataaacactgtaatgaaagaggctgtatcatggtttccttggaacaccacataattcctagccccaataccttgcacactgtaagcacataatcaacatttgatgaatgtgtgaatatacttttcagtattttaaacttatatttttccttcacataatttaaatactaatgcaaattattaagtataaaaattagggcaagttgcaaatataattcagtcacagcctccgggaaatgaataaaataatctcactctaggttgatttctttgtgtaaattagatccttactaaatatttgcagacttacacatttataaaaaaaagtcatcagtctcatctattctgtctctattagaaaagggtcaatctatgtttaatttgctgccataagcttgaaggtgaaaatttatttaggaagcatttgatgactgttttctaggtactgttcttaatctaggtatgttaagggatggtgcctatccttaagttgctcacaacttatatgagagataaatttggaatattcactgctgtacatattgaaggatttattatatttataattaaattctaccaaatcacatatggacataatttaatcttcttgtgttattagcacagtgcactgatatactgaagaatctaatttttcaatgaaataaggatctgtccaatttagcatactaaaatagaataacaattttattaattttcatttcaaatcagcattattatattatcttaagattccctttatttgtattccttaaggatgccaattctggttttacaaaatcaactttatattcaatacttttttgtctgaactagacaactgtatacatatgccaagtattttagaggatgaaattttcaattggaaatctgactcctatactcatgatgaagactgttacataatttctatgtcaaaaacatatttaaagtttacctgttttgaatggccatatagcttgttgacgtatatatttagaatcaggacacaaaaataatgaaatgatacaattaaatcaaaatgtaaacaaaatattatcaatattattaaattaaggaactccgaagtgccctatcgtagattttggtacttactgatgcaaagtattatggacagcctggttaagtcctaaaatttgtaaaattcgttacctacttaatgaagtgtaaagtcaatgaatgtgctgctttagtgatcacaacacattctgttagttgccacatgttgatatttattctacttctcctagggacaacaggttacttagtcaaacactttatatgtaacaggttacttagtcatacactttgtttatataatgcaaattctcattcccattttgtcttaagttataacataacattttaatgagttctctgtaccctctcaaaaaacatcatggtaataagaaaaagaaagttttattaaaaaaccctaatccaaattcctgctttcaagattgggggttggtggggggggagctgcgaaactgaacttcttaagattaagagctggccgggcgcggtggctcacgcctgtaatcccagcactttgggaggccgagacgggcggatcacgaggtcaggagatcgagaccatcctggctaacacggtgaaaccccgtctctactaaaaatacaaaaattagccgggcatggtggcgcgcgcctgtagtcccagctacacgggaggctgaggcaggagaatggcgtgaacccgggaggcggagcttgcagtgagccgagatcccgccactgcactccagcctgggcgacagagcgaaactccgtctcaaaaaaaaaaaaaaaaaaaaattaagagctttctatatacatttcatttccattttgctcaaatcagcagatcctccaaaagtaaactgaggaacatttcaaatggcctagtatgttgtattctgcaaggatgaggtatgtgaactggaatcagaccaaggtgcttttaaaatctgttatatgtttatgagagattgtactaaaaggactctcaatcccttaagactgaaaattcactacccattgcaaagtctgggtctgtttgctttgggtttcttctggctttttgtttgcttttcaaacaaggcgttttattaacctctttagggtaattccagtgatgactcatggtcatggagatgatgatggcagcttgtagcctacactagctgccagctcccctgcgagacagtccaatcaatcagtaagtatttatggcattcccgttattttcagaacaagatgttagaattaaaataattcaaatataaaggagtaaccgtttgatgcttactgtccatcagggaggcgaaacatatactacatggagaatgtcctcagagagacacaacaacgttgaaattcctaatctatggcatttgtaacttacagatgtggcaacatgagaaagcaacttgccctcccatctccgtatctctagctgaaccaccagttctcccacttttcctactcgaatggtgtttattttttaaaaacatgtgttagcggccaggagccgtggctcacgcctgtaatcccagcactttgggaggccgaggcgggtggatcacctgaggttgggagctcgagaccagcctgaccaacatggagaaactctgtctctactaaaaatacaaaattagccgggcatggtggcacgtgtctgtaatcccagctactcagatggctgaggcaggagaatcgcttgaacccaggaggcggaggttgctgtgagccaagatcgcaccattgcactccagcctgggcaacaagagcaaaactccatctcaacaaaacaaaacaaaacaaaacaaaacaaacaaaaacaaaacatatgttagccttttatctttctaaaacgggctaaacattattttgcttaaaggcatagaaattaatgcctctgagaaattttaagtcccatgagtcaataaatacccaatatgtttgaacttaattgaaataaactatcacaaattgatagtttatatatcagtcgtatatataaaattgacatataagcatgtactttataactatctacatgcatgagtatataagaatacacacacacacacacacacacacacacacatatatatatatatatacacatatatttaaactttcaataactgactccaaatgtagcctcctttcagcataggtttggggaaagaatacccatctaacacctatttttagaatcagaggagttggattaaatcctggttccgctatctgtgtgatcttatgcaaaatattaatatctttgatagttggttctctcatttacttaataaggacaatatctaccatagggactgttgtgaaaataaaatccacttatatatgtataagagttcctcatccaattcgtataaagcacagcacaaatctaaagtattactcttttatgagatactttaaaatctgaataaagttagattttatttgtcccataaagaagtgaaaattttgacagtttcaaattgtctgaaatgtttcatattctggagttccctggaacatgtttttagttaccaaaataccaagctactgaagggaaacgtgggcattttggttgccctgccagacattaagaaaaaaatgaatcccattctatttattgctatgtctcttaaagtacgtttggcatggtacccaacattgagagacacataacctgctgtcctaaaactctgagcaatttacaaattcttgtaatcatagaaagaattccccattttacatcccaaaaggactgtgccttctcctcttagtggctcctacaagggattagactaaaccaaatccttcatgaggaacaggtaaagtgccattgctttaaaatgccaacgtgagcctatatattcctgtgctgttcatattaccttatcgttctgcacaattacacttgatgttcacattttcaggttgactgggttttatcacttcatggcacacttttctgtttaattacagagaaaggtgttttcccctcattcttattctgtgcatttgagacttgattttatcttttcaaacattctgttgtttgaacagacaattttctgataacaagtgaatcaaggactccctgcctttcctttcctcgaccagttctacgtttttctgagagccagctgtggcccagggcaacagttccatggttcctgtatgaaagagaaaaatctgactccaattgtcaggcttattgtatctaccactgccttgtatcctttgtaggggacccccaatggctttactcctatgacccagggttagacttagagatggtaataagccaaaccatgcagtaattggaaacactgaaaatagaaaattctgtatacattttgctttatcttaatattgaaagaaaatatcagagcatttcatttattcattcagagaatcttgatggaaaacctatttttttcaaggccctcgactggaatttaagagaagcaacactgtcaggaaagacaaatttctcgagcaagttctaaaaattctgtgcatagacattagaacagttaccaatattcgtgcacccattttctagatgtgaaaatttttttactcttatagctagcagggcactatcattgtcaacccttgagaaggcctagtggaactctcaataatgaggatagttgattgttatggactgaatgctggcatcccccccgccggctaaaatttgtatgttgaagtgctaacccccaatggatatttggaggtggggcctttgagaaataataagggttagatgaggtcataggttgaggcctccataattggattagtgtccttttaagaagagcaagaagagagactagagtacctctctgcaccacctctctccccaacatacgaggatacagcaagaagaaggttctcaccaggaaccacatctgtcagcaccatgatcttgtacttctcaacctccagaaccgtgaaaaacaactgcctgttgtttaagccacccagtctatggcattattttatagcagcctgagcttactaagacattaatatttgtatagtgagtagccatttgaaaaggacttttccatgcgtcatttcattgaatcctaacaccaaactagtatggaagttatcaggatcccagttttacagatgagaaaattaactgttggagagattaaataatttgccatgggtcccactgtcactaagggggcagagccagtgcttggaccaagtgctcttattttagattcagtgctgttactactatattactaaagaaataaaggccaaagaatctccaggataaaggtagaacctgtcaaacggataaaccaacatcagcaaccatttgtttcctgacttctagttttatatgagaaaaaagctcctgtttgttttagccactgaagtaatatagtttattaccttcaactaacaagagtcctaatggttacccctcagtccagtctttttgtgtaatcaggtagatagtatagctttcctctaatccagaaatcaagaatggggattaaggaaattaaggaatgaaattaaagaaggacattcttatgtatttatctcactaacataaaagtaataatcgcaattgctttcatcaccattgttataattatctcataaccaactattagcttcctaggtctttttgttaggcctccaaaattcaaaagctttctttacaatacccatattttccatgtggagccaggctgagtggacctgagataattatcatcatgtcccggagctataaagttttggtgggttcttgtttctttcaagaaacaaaaacacatgttattctgcacgtgtttcctgtacacatgtaggataaaggacatgtacaagtagtctgcaacttttagggcaaagagtatgattgacatttgtgggagtgtctaatggggatattcaaagcaacatgggatcatgtttcagaaaactcagggcaaaactcataggttgcttgtcctggggtaagccagccaccacatcataagaacactcaagtagtcccatggaggaactcgtttagagggaaaccaactagacagcaccaactcacaagctatacaagtaactcactgtgaaagtgaatccttcagccccagtcaagccatcatatgactgcagcctaattgacatctgagtgcaacatcatgagtgatcgtgagacagaacccctcaaccaagcaatgcatgaatcctgacctacagaacctatgagtgataataaatgattattgctactttaggacactaagtttggggtgattgttttacagtaacaggtaactattcaaactctttcctgacaaaagtagaacaagctcggctttccccttttcatgtagaaaggtcacaatctattaatccttcctacttactttataaatgttttacttaagacaagtacaacagaataaagacaggtggcaagcaattttcaaatcatgtataagtaaattttggtaaagaaagaagtagtaggtacaaaataataatccctacaattttctataacttgagagctgagagcattttttaggaacagtccatggcacgtgtttaacccttggcttagttttatctaaaatgcatgatgccatcagggagtaatattcctatttatgcccacaggtaccaaaatataacagaaattcaagactttagttacaatgaccctgtaggtcataagataaaaatgctagcctataaacatgtagagtatctctttctgggctcatctctgtttgtatttgtcttattagctcactttgtctgagtataaaattctttaatatatttactcataatcatctttatcacaaaaaaggaagaaaaactattttctttaattggtttatttatttaatagttttgtttattatgtttaattttcaaggtggatgaataaaacatttgttaacccagatctttccccttaaaaagaaacataatgaagacaaaaacaattagtagaaaacactatttatgttcataattatggtacatcactttaataaaaaatatttttcctattataaactcacttgaaagatttataattaaatataatcgcaacaggtaatttggattttaaatcctattcaaatatgttttgatattaatcctcttaatttaaaaatgaaatacatttatgaaaaatggaaaacattcatttcatgataggtaattagtattaatttaacacaacgtataggaagaaaaaacatacttgttttttatatatcagtttttatatacaagttacaattactctgatagaactctgaaattcattaagatattaaagaccatttctattatttaacgtatatttccaggtaccttattaactaggtactactaaaaaaataaaagaaccacgagatttatatgtgaagaaacacatgacattatgaacctcatgatgatggctgatgatggtaaattttatgtgttaacttggctgggctatggttcccagttgtttggtcaaacaccaatctagatgttgctgtgaaggtattttttagatgtgattaacatttcaatcagcagactttgagtaaagcagattaccctccacaatgtgggtgggccttctccaatcaattttgaagtccttaagagaaaagactgaagtccccagaaaaggaaggaattctgctatcggattacctttggactcaagattgcaacatcaactcttcccttggtctccatcctgccaggcttttggattttacagatttttgacttttcagctcccacaatcatatgagttaatggcttaaaatcaatctctctctctctctctctctctctctctgtatgtgtgtatatatataatattattatatatattagtattattaccaatctctctctctctctcactctctctctctctctctctctctctctctctctatatatatatatatatatatatatatctcctaattattagatacaacagaagatagatggaaagagacagcagcattctaaactctaatgataatggtgaattgataatacaggtgaaatattggactgtgagttttcagatgatgaaaacctagataaatgttctcaggcccaaggactgattaatgcacaatatatttctaatgacagaaaggaaatatgatattttaatccacttaattattcaacaggaagaacttcaccacataatattagctgtaagaattttaacaatcctgttttgctaaaggatgtgtgacagatattatgtcatttatgatgtttgtgcaccaaaatttatttgatacaaaaagtaagttgtatttcttttttattatttatttatttatttatttacgatggagtttcactcttgttgcccaggttagagtgcaatggcgtgatctcggctcagtgcaacctccgcctcccgggttcaagcaattctcctgcctcagcctcccgagtagctgggattacaggtgcccgccaccatgcctggctaatttttttgtatttttagtagagatggggcttcaccatgttagccaggctggtttcgaactcctgacctcaggtgatccatcgcttcagcctcccaaagtgctggaattacaggagtgagccactgtgcccagcctgtatttcaattcttattaaaatttctcataagattgtctttcactatctctttatacttccataagaatttgtagagtaacttagacatatacaaaataaaaagctaaagggttcattagacctacaaggcaaacagtaatggctaatttccctggtatactgagggctgcatcagaaacctggtctacctaaacacaacaatctttaatcctcagctaaagagtttctatactttattcatggtatcattaagaaccaggatgaaacttatgttacttgaatggttgtacagcagcagaaaaaggaaaccatacagtgtagcatctataaattcattatttaggctgggcgcggtggctcaggtctgtaatcccagcactttgggaggccgaggcgggtggatcacctgaagtcaagagtttgagaccagcctggccaacatgacgaaaccccgtccctactaaaaatacaaaaaaattagctgggcatgatggtgggagcctgtaatgccagctactcggtaggctgaggcaagagaatagcttgaatctgggaggcggagttgcagtgagcaaagatggcaccactgcactccagcctgggcaatggagcaggactctgtctcaaaaaaaaaattattattcagtgtgtgtctaaatgcttctatattgtaagttggcagggttgggggttgtgtggggggtgggtggtgctacctcttctcaaattccttaaatgtaaaccaacttctaggctttttcctaggttcacttttctttgcaccaggtaccctctctctgtgcaagctcagacattccaggtaacttttgaattcttgtccaaaagtaacatcactcctgcaatctctatgttttcaaccatttctttaaaatctcagtatggtcatctagcttcatgttaagcacattactttgtctcccataatcaactccttatcctgagtttgtctctggttatgacattaatcttccaaagaattcaatctccaactcttagaggcaggccttctcttagattgacagttttatatatgcaatcaatgtcaaaatcctgttaattctagctccaccttatgtctcaatttcacttctttctttttactccatggtcactgctccagcttgggctctcttgccttctaactggtcttactgacttcatttactcccttatcctccacaacacacacacacacacacacacacacacacacacacacacacacactcccatgctgatattcgtcttccaccccactgttaacaggtctaattatgtattctcctgtcatcaattcctgaaatacccttccctctccagcttccttctgcttttcaaagtcttattcatgaccaggtcaaattcagcctcctcctggaagcattccactaagccctcatttaaaactcctcctctagttttctctcaacattttgtaatactgctctactgaagcacctatcctaaactgccttgcctaaatatacttgtccaaatacccacatttgattgtgagctctttaaagacaaaggctgaatcttacttttttcctgtatcccctctaccatctctgatattagatagcacagagtaggcattcaaacgttcgctgaactgaactgaactctttggttgccagcggcatcctagtggatgtgaattttgagagctgcttgtagctataacaggttgacagcaggtgctagatgtcaaaagaaggaaatttatatggttgactccacttcttctaaaataagcaaccatctaatagacaatacctgagaggaagatactggctggcatttcattagcaacagagatttcatacaaatgtggagaacaacagagcctttttatttcgccatgaaggatttcatagatttggttgcagcaatgaatgatgggttgacaaagctgctataaaactgtcagttaattcaaaaatcgtgtgagagatgtttttttttattctcatacagaagaacattctccccttctatggccctgtataccagttctttatgcaatataatgtgaattccttttcttaaaatttataagctatcactaaatttctctaagaattctggactgggttgaaaaatccttagctgaaaaaataattccaaaataaacgactccctcttaaaacttggaattctgtttcagaagtccttcccttggtttagctaataaaaggccacattatacacccttcatattctcccatctccagttctctctgtaccaaatccatctcaccataacaatatgtaccatttaatgagcatctaatatgtgccacatatttactttagaaacaccaattattttactttcttaatcaccctaccagcataagtactattattagccccacatgacagatgagagaaccacagtttaggaaagagaattaacttggctaaggttacacagctaatagatcattggggtccactagtctgtacatctccaacacatgtaaaagacaatcctttgattagacactcaaatacacagaagtcaaaagtataaacaggagcagcaaaaatgtatatccagactataattacctgaggttagtcctaatattttaagttgtcagataaatataccttcctatttttctgactaaccagccttttccatttgatgtgcctcgggctttaaaatcatatagacgtgggcttgaattctacttcctcacttgtcatcttcctaagaccctagacaagttacgttagctctccgagtctcggttttctgtctctaaaatgggagtagtaattttatctacctattaaatttatagataataaaaattttgcagtatttcccacaaaaggctttcctgaatatttgtttaattctatttatagatcttattccatcttttccaagcaaccttctcctgtcggtcttttaaatctctccttttggggtggtggtggggggcgaaataactaaacagctaccaaaaagctcattaagtattttgcattaagccttcaaagcaccccaatagattataattaaaataacaaatgctaacattcattcagcttttactatggccctgatctaagggctctacattaattatttcatctaatcctcccaacccatgagatagttataagtgagcctattttacagagaaggaaactaagagcagatagtttactgagattagtcatttgctcaaggccacaaagctaacaagtggccagtctaggcagcctgccttttaaagtaatgcatgctattgctgtatagccccgaaatggtagtggtgggggttacggagggagaagctacagaaacaaggctcttaaatccaaatgttacaggaacgacattcaccaatattgtttgtgaaataaacagaatgataaaaggaagcagttttatctttccaaatcctcttcactgctatgcaaggtattatggtattatgccttgcagtattaacagacacgaacaagagtttcatgtaattcagacgcctccaaggaagaaaatttaaattcttctaatcttatctgcttttggtcccctgacccagcccttttgcagaagaaaatggccaggaatgattgacaaattcagacaccaaagagttaaagaaaaatgagcaattcgaatattagaaagagggagaatttttcatttgatctgatttagacaaaatttactctcttacctagattattactgcatgatttccatcaatataattacctgaatacaacagataccacggtaatagtttcatatagtaaaacatggtggtggcttgcacacccaattacttgaagtttaacatgaatatttctagtagacataaatagctttgtactgaacttttctcttgatagactgcaataactatgtatagattttcccaactgttcaaagttatgaaatgggatttaccagagaaagaaaaatgtttcaatatagtattacatacatatattaactattttttctttatttagctgatttctttttgagcatttctagaagtttcatggcaataaaaaggaagaccaaaatcatcaaatgagaaaatacaattttatgagcaagtattttatttctgtccttttcctgaaaaccaaatctttactaagaaaaattctattttgaacacgatcgaaaagtttatgagtattgaatttccatcccattttatagatttcaaagggagagataaactgaagtgtagcagggctgcaaatgacattgtttagataaacatatcttgtcagaattatcctggtaccatttagaggctccaggcatatttggaactaagattccagcttagactcttaataagcgctatgacacatctcgacagacacttgcttttaagaaaatgctttcttggaccatttggattacagcctttccactaggctgcaaatattcataaaggtattcattcctaaaagacaaaagcttagaaaagaagaactattcaaatcactgaatattggcagagagatacaaacttgccctccggtcattcaattttaatctctatcatgaaaaagtcaatgcaatatgaaaaaaaaatgcaggggataatggaaaatgttcagacaatgttgaacaaatactgtataatacattcatattgtcttcctcttagggaaaaaattgaagtgatttttcattagtaaaataacaaatgactctctgtatagtatgttcagatttgcataaacctcactgccaaatttccatatttctcaggcaagaaactgatcacttacctgtgtaatgggaattcagtctcatattgagtaaatcactcactaagattcactcttttgggtcagtgtgttgcaacttgttggagaaccctcaaggttccagtatggtggaggaatgctctgctaaatcaattgtatggctatcttaccaaatctgttcctcttcctaggctcaacagtgtacactatttccctaattccctcgcagttaggtgtgaccatgtgacaagatccatccaacagaatatgaacaaaattaacacacaccatttccaggcgtggctcatgacaaattttcatgagtaatactcattcttcatctgcccattaaatgcatatgagtcttatgctctggacacaaaagatggaaggagcttgggttcctgaatgacttcatagagggctgcttattttggactgcactaaaataagaagtaaatttctgctgtagtaagcctccaagatttgggagattacctgttatagtggctagtgttactgaaataatacattagcatacatccacattcattgtttaagcaacaataaagagttaaactttcaaaaccaagaacagcctattttaattagcaatcactacaactgaaagaagacatgtctttaggaagtgaatcaaaacatacataatttcagacaaaagaagtatttagtcttagtacaatgattaaggtcattaacaaaagcaacaaaacaagatgggaaatggtaaacatactagaaagagcgcagattttcaagtcagaaagagacatttacaaattccaagctctgttctttgcttgtttgtaaacgacgcagtctcgctctgtcgcccaggctggagtgcagtggcgcaatctcggctcactgcaagctccgcctcccgggttcacgccattctcctgcctcagcctcccaagtagctgggactacaggcgcccgccaccacgcccggctaatttttttttgtatttttagtagagacggggtttcaccgtgttagccaggatggtctcgatctcctgacctcgtgatccgcccgcctcggcctccccaagtgctgggattacaggcgtgagccaccgcgcccggccgagtaactgttcttggaacctgttttctcgtctataaaatggggattataaaatatagctcacaagattctgtaaagattttgtacacacacacagaaacacacagaaacacacacatgtgcacacaccatctaatgcttatgaggtactgaataaatactagctattatcaataagtacttacccaatatgtggaagtatgactaataatattttaaaatattaaccttttactctggttactctttcactttccccaacatattgacaactagtcatttccttagggaagggttaacatagcagaatataaattatgaagatatagactctcatggtttccgagtttgaaaagtctaagcctggtaaaagacaaaagatttcaaagagaaaaaaaaagatggctgaaaggttttcctccttcctgcactacaaaggattcttcgggttgtgggaaggaaaatgaggggatattgcagaggaagcaagaaaattcaataccagtgtgtgtccctggagggaaggaaggtagagagaagtgaagaaaccgagagagatctgagagaacctgaaagcagagctgacttggacctcatttctgaggagaatctctgagggaaaccgggtggcgagtttcccctactccttcgtctgtcactcttcctgaccccatggaaactcactgacacaacacacaatcactgcgaatcactctccccattaaatggataggagtgtatgtcagaagaaaagaatatgcacagcgtctagtcagatgggtcttaccaaagttcctgcccaccctactacggcataaggtacagtacgatgatttttgatattacaaaatgggggcatcaaagtagcggagagatatccagatctgaaagtcactgcacatgggaatgaaagatggcccaggaagaagccactgcctgcttggaccaacagccaaggatatgagggagagactggcatctccatggatgccagcccagatgacaactaaagaacaaatgttctgccacaaatgttctgccacactgtggtcaccacacccatcaatgcatgctttgcaactatataagccctgaattgatttaaaaatgtatttcttctattcaatggaattacattcatttattaaaaggtaacattatggactgaaaatctcagcacaattgttatcatttacaattatttcacattatttttataaatgtgagggggatatatgaacttaagtttttattgaaacttgtcatgcatcttgctttgtgtgtcccatgcttgttaaaaaacttacttcgatccgtaatgattgttctagcctcttgattgctggtcttgtttttcaaattttgggcagcggtaatgagttcttccaactggggacgcctctgttccaaatcctgcattgttgcctgtaagaacaaatatcccttagtatcagggttcttcagcgttgtgtattccttttacataatacaaagtaaagtacaattgtgagaccagccaaaacacttttagaaataaaaaagatgttactgtataagggtttatagaaaacaatttaacaggaaatatgtttcattcttagatatcaaaaatatttcaaatgaaaatcttgactatagattttcttcatttaaaggctcaaatggagacattccggagtacctcggattacttaaaccactgtctgaatgccttgagtaagaaatgttattctgaattacgacaatgtatttaaaagatagataactatttatacttataatatcattctgtgtgacgtcaaaattaaggtatatttattttaaaaacagaaaaagcacagaaccgatttaagagatattacttatttaacttcattgtacccctgagatttctcacctgtcaaatgaaaaggtgaagtagacgagctaaatcagcttttctcctaagctgcctgtccgtaagaatcaccaaacctttttgcctccctccagaactaatgaatatgtagtggaaagggctgcaaatcttgcattttaaataaattatctaattaacttttatgatttaggcaagtttggagagcatcagattacaggttagtattcctattcccctgtattataaatgactttaatatagcactattttaaataaaaatacaaatataataaagttaacaatttttaatttataggtagtaatgtaaatcattaagatattcttccctttcttcagtgtctattttctctgtcatcttagtctctctagatttaaggaccacaatctcagaggtatttatgaagaaatttatgaaaaaaaggcatctgactagctctggttctaaaactcagtaaattttattttaattggggaaaatacaagtaatatttactgttagtttataagcaatatgtgacagatgttttatctatattttctcatttttttcttataataaccacactagtaaacaagccagcaagtttgtataattttaaatatgatgttctaccacatgaggccaatgaagatgaagagatgaaagtggtagatagtaatgtatctgaaacttatatgaaacttagttatttactctgtactttgactcctgctgattttctaacgaattttggttttggaaaggccaaattttgatcattctgtagtgtttcttctgtgaagaggtagggagacaggctttgtgatttaaactcaattgcttttggtaatagtaaaataatgcaaaaaacttttccaaacattgtacatctactttaggcactttctcctctctgtattgaaaaattggaggggctaacttttaacaaattttccacatttgtaagctgtgattgctcagaaaaaaaatccaattttcaggtttctaacttttatggtttctttacacaacagagtgtttgaaatatggaacaaattgccaaagacagctattgaagtaagtggcataagtcagctggagagtactgaacaaattttaaagtaggaaccatatagtagcaggtagattttatgaaataagatgttttccagtgttagaatgtgaaactctggtcatctgtgacatgggaagctgaaaggttgctttggaattgcctaccctaaaatgtttgaatatgttcaatagaatttttaaaacggacttacccagaaacctcagatgaagtcaaattttcacctcaaagttaacagagaactttaaatacacagggctggcaaaatacataaattcatttactcatccattcattttaataaatatttttcagcactaggcactattctagggactatgcatgtggcagtggacaaatatattcggtatagtgtgtaactcacatgaaaaatcgtgcttttcgatacttggaaatttttatataacaaagattatctttattgggttgttcttcttttaattcactctcacataaccagattttttttgcttctcagttttagatacattattcactgtttgctatacttttttccttcttttaagatttcaaagttcatttaagaagtatgttgtaaaagtaagttgatcaactttaatctgaaccttaccaggctctaaattaaacctgaccacaatgaacagcttttattgctgaaattagcaagcatgtcaacttagactcaaaacaagccattttcctctctaatgaacaaaataggtctcagggtattgtgaaacctgttctctagttgggtgattctctaattctgctgacagacacatgctttgtaagcacctgagaagattattaatgagatcctttgaagcagcctccttaaaaatctaaggaggttcacaactgcagtacaactatgcatttctaaaatatttcaaaacaaaatttcaactttttatcccactctatggtcaacacatacaaacattcatttcaacaaagaagctgtaaaatgataatgtatattgctatgggatttatcatacactaataggctctttacttagtggtcttttagtatagcagaatgggaattttctcctttgattccctttctagaaataaagagagggatttaatatggcatacgcttcagtattttttcattaagatattataaaaacagtggttaaaagaatttcttgctaataagaacacaagcatatggtgagagtaacgattatttttcatttggtttccttttaagggtattctatttatttgctactatactttctttgacttcaacttagttttataattccagaacttctcaaataaactgaccttcacctctattccttcgagccacccacagatgagaaaacaccttagatctaatcattactcaaactacttgcctccaaaatatccatctataaaattctgttctctgcccccaatctgctacccctaccagatgttactctcccaaacatgctgttcctagtattatcttcatcctcatatgacctctggtccttttctgtttcctcaacctagctttagtcataacaaacaagtagaatgctaattgtgcttatttatttctctgatatgatcccagatatttgtgacacaaataacttaaagcgaacaaaactaaaatcattacatgcttaccagtacctaagcatgataatggatcgtgtctacatggattctatcattctagaggaaacaaaacacaggagaaggaaggaatcaatgctatttctaaggagtcataagtcagctactgggctttactaaaaactgcttaccccttggagatgagaattcatcatggattccactagctgagcaaagatggaggaaaaaaaattcttcaaatacaaagtgaatcagaagtctttaatctcactaagtccccccagagttgagtgaagtggttataaatagcaaccctatgaaataggaagttaaacagtgaaatcatacatattataactagggcattttaggcttttagacaaaattacaattttttattgtattcattaaaatagaattccacctaaataatactcaaataaaaactctatatgttgagttgaatgcttagtatttacatgtctaagaaaagactttgaaaatcaaactggtcatatttttatatttttctataaaaatcaacaatctacatagcataaatgcccatgatgatttttcaaatgttcccattttcagtaaatgaatatgaattaagctgaaatgtaacaatgtagaactgatgctattttatttacaacttcaaaaaattaatataaagaattcagaaggtaaaagagtttacggaaccattttatgtattgaagaaaataagcatagaagtcaggaaggtactaaattgtagcctttctagttaccgaaagggttttactggtgaggatgctgtaatctatctagctttcaaccatctcactgagcatcttcttctggcttctattcttgcattcggctgcctctccaaatagagtggccaaatcgaaaaccatcctcattgtcttccacttacttcctcacttctcatttccattttatactggcttggatattgatattttcctacttggtcaaccttccctacttcttttttgaatgttctactagcacctccatcggtaacttcttaagaatcttcataaccaacttcataaatatcttccaactgcagttagccttttttgttctttattcactgaataaatactttataagatgcattttatttttatataatttcaagcttgcagaatatttgcaagataaagaactcccaggtaacccttgcccggattcaccatttgttaacattttgccacattatttttaattatttatcattttatcattctctctgtgtgtatagatatataactgtatatgtaatgttttatatatatatattttttttctgaatcatttgagaataatttgcagatatcatgcccctttacccttaaatactttaggttttatttcttaatagcaaagacattctcttaaataacctcagctcagtttcaaagtcaggaaatttagcgtggctttagtaccataatcttatccatactctatattcagagtatgacaattaccccattaatgaactttatagctatatttttatttcctggtctggtccagactcacgcattgcttttagttgtcgtatctccttagtcttttttaagttgaaatagttatttgcctttctttgaactttataacacttacagttttgaccaacagaggccaggtattttgtagaatatcccccaaatttgagttatagcaattttttaagtgcttctgttgtgtcactcattgagctaggtgcaggggctgtagcagtgaaggagaaaataattcctgttctcaaagagaaaacaaacgagtagtgatgacaggcaataaaaaagcaattgcaacaacctgaggtattatggtaggggaaacatggagagttatcagagcatatggcaaagatatcacatgaaatataaaggccaaagactgtcttctgaaggaatcaagcttaagtagtcctcagcttttctttatttaaattatacaaaacagttttaaacaccactgctcctcatacccaagtggccaccatgagaatatgcaggccttctattattgggtcttaactgactgaggactcctgttactgcattttgaaatccatgattgcactgcaccaaagccaagcttctcacagacttctcctcacccaatgattgggtgtggtgggaatactaaggcagagagccttccttgggagacatgggacttctttgcctggctctgcctcaatgacttcccaacagctttgccaaaatttccttccactagaccgcacactgggatgcttctgcctagccttctctccctctctcttccttgcagagtcagaattgcatcttgatctaacatctcttgcaccttccttggcttcctccttcttttctttcacatagatatttccactaataaaatattgtcccattttatcctgtctgggtacatataacctcaggccctgactaatacactcacttttgtcctcctagaccctaaacctctcatcagctcttcagttccatgtaacgtgatggttccatgacactactacctgaatgtgtaactgtcaattattgaatattaattagtaacataggtttcttcatgcctcccatgggctggcctcttaagatgcaattcaagtaaatatgtatttttacatactacctctatttagaaatcactaaggtagggtgcatgaccattatttccaaggagcgcagaatttaactggaggaaaataagagtattcagatgtgttacatggtaatggtggagttccattcaacacatgcagctcaagaactgtaggaaactaaagcaagccaccaggaatccttaacagataacaaccactaggtttgctgcaagagatggcaaaaggaactttggggcaagttttcagatgacggaagacagaaagttaagattattccacctctctgagtgagaagtgccctaggtagacaaagacctcaaccaggaccagcttcttgaacgtataacttgtgcagttagttacacaaggatctgcattagaagggattcatacttggtttcatgctctactgttgccatcttgaaattcttaatttttttttaaccaagggccctgcgttttcatttttcactgggctctacagattacgtacctgattgtgacctcaaccctaaggttagtggagaataaaagttatgtatcttggctgaagcactggttaatcgttgatgggaagaacacatttaaacacaaattaaatgacgtcaatcaaatgcctcttgcttaattcctgagaatgcgtttcaaatttctggaaggagcagttatgaagctaaaaaatgtattttgggggaaatctggcctcaggaaaagctgaacaggacagttagaagtggttccaaggtgggactgtcatcactatcaatggttattggagaacaaaagtcactataggaaaaatgaagtagggaaacgacaaagaaagtggtgaatcatctgaggaagaaattggagataaaaaggagaacctgtggcttcagcaacaatgatggctgctgaaatctcaaatgacatttctaggtttagctaagtgttagctgtttccaaggctaggatagacttgggaaatacataagaaacaactaataatttgttttagaaacatttactaaactgcaactatttgccaagcactcagctagtacacatagacaaataaaacttgtcttcttttttcaaggaacttataatctagcaaacaaatactcataaacaattattttttgtgtaataatacaatgggaagtaatgctaacgacaacaacaatagttgtttattgagtgcataccatatgccaaaagagtctatcacagcatactagttaaaagaatgaactctggagtcaggctttcccaatttgcatactggctgccacctattcggtttactattttcagtatgttacttaaatgctgtctgtatcatttccagcactgtgaaatggagatactgagtctctacctctcagattcattatgagaattaatagagttaatatttgtaaggtgtttagaacatttcccatttcatagtaagaacaataaaagttttaaataaaaactatcagtcaatgtaattatcatattactctgtgaggtgggtactaatattgcccctattttactagtaaagaaaatgaatgaaaaagaagttaaacaatttgtctaggatcacatggtaataagtggcagaacttctaacataggtaagttggccccaaagcccacacacttaagaactataatatagcatgatatacttacaaggtactcatgtcatagtataatataaggtagctatatgatagtatgatataatataggaatggataaagggacagggatatgaaacgagaatacaaaaggggaaattaactatttcattcaaggacagattatattctgaatcagtcatggttcttgcaataaatagttcattcaaagtgggatgaggaggctttcctcctcaaggcctgaaaggctaaggggagggtatagttagtagaatctgagaagtggctgcagggacaagacctcttgacaggagctggggctgtgagtaaaggaacctagccatccctcgactcactctcctctcatccattgatctgctgatgcctcccaacacaaggaccaagccaatagacaagcaagcccaatgctactgccatattggtcaacctcctagggtagaacaacaggttagagattggatctgcgaaagtatccagcaacagtataaaaaaaataataataatggcaacaactattgaaacaaatcagtgaaggaaatgaccacatatgggaattctcagcaaagacttcatatcaagtatggcactacagctgaactttggcagatttggctagagaatgagaagagcattataagggaaagacagacatgaacaaaggcatgaacgtaaaataaagcctcaaatgggctggttagagcctggaattctttacaaataatggcaaataagtttaggtagacatagtagaagcagtatatagttggctttttaaaaatcagtttgaggttttgaattttatcacaaggacaactgggaagcagcgaacttgcagaaaaaaactgaggctataggagcaaagctttcagtaatcctgtgcctccatagattttgttctttctggttgggataaatttctcaattcttggtccattcctagaaatacagttaacagatacccatacgtaaaaagtgttgattgaccaaatcactgactacaatgaagggaaacagtggtacaagaaacaagtaattagagacttgtggcagatcaagaatacatacaaatggcaaacaagcatatgaaaaggtgctcaacatcactgaatcattgataaccagagaaatgaaaatcaaaattacaatgacatattacctcactcccgttaaaatggcttatatccaaaagacaggcaataaccaatgttgacaagtatgtgaagaaaaaggaacccttgtatactgttggtggaaatgtaaattagcacaaccactatggagaaccgtttggaggttcctcaaaaaactaaaaatagagctaccatataatatagcattcccgctgctgggtatatacccaaaagaaaataaatcagtatattgaagagatatctgcactcccatgtttattgcagcgctattcacaatagccaagatttggaagcaacctaagtgtccatcagtagatgaatggacaaagaacatgtggtacctatgcacaatggaatactactcagccacaaaaaagaatgagattctgtcatctgcaacaacattgttggaaatggaggtcagtatgctaggtgaaataaatcagacacagaaagacaaacattgcatgttctcacttatttgtgggatttaaaattcaaaacaattgaactcatggacatagagagtagaaggatggttacctgaggatgggaagggtcgtggggaggtgggggtggtgtaggtatagttactgggtacaaaaaattagttagaaagaatgagtaagacctactatttgatagcacaacagggggactataaccaataatgatttaattgtacattttacattaattaaaagagtataattggattgtttggaacataaagaataaatgcttgaggggttgaataccccattttacatgatgtgcttactacacattgcatgcctgtatcaaaacatctcaagtaccaaataaatatatacacctgctaggtactcacaaaacttaaaaatataaaaataaaacaaaaagaaacaagtaattagaatcagaaatgtgtggaaattgctagaacacatgttccttttctaagcagtatttatcagtattataaaaatcactgatcatttggctagctttaaaaataaaaaatatgatagctgtttaagaaatcattattagctattcaaacttaaaaaacaataagacagtcagtgaaatttatttctctatttctttgtagtaatgtttcaatttgttgatattttggggagttaaaaaaactcttaagcctagcactgcatgttctcactcgtaagtgggaattgaacaatgagaacacatggacacagggaggggaacatcacacaccggggcctgtcaaggggtgaggggcaaggggacagagagcattaggacaaatacctaatgcattgggggcttaaaacctggatgttgggttgatgagtatagcaaaccaccatgatacatgtatacctaggtaacaaacctgcacgttctgcacatgtatcccagaacttaaagtaaaattaaaaaactaaaaaataaataaataaatataaaataaataaaataaaaaaagagcatagtaatctcaaaaaaaaaaaaaaaacctcttaagcctaccaaatttggtgacttctttgaaatggtaataatattaatctactattagtgtgttatttttaaaataaattatctccctgtgttgaaaaaaagattaagatggtcctttccaagctattataccacacggaacttaaaggattgatttacttgtcatttactaaaacccttaacatccaaaaatgaaaatgcctttcactttcacaagccagtaagtaaataatgtggtgtaaattgcggatcttgaaatacaatttcaaagtcaagaaaaaaaaagaattttatgctacaatttgttgataatgatttgcaaacgcatttctaaagtgatataaagggcgttgataattttagctattcaacgttagatcttttagttattctacattgttcacatttcttgaaactctattgttctataaatttggcatattaacaaaggataatcaagacaggtttaagaccagtttttatcatgtgcatcagattcgcaggcttttgatattatggcccagtaacataagtgatataattttttctcctacacacattttagaagaaagagagacatgaaacaatatataggactgccttggaatattgtgtgtttggttccagactgctgcaataaagtaaatatcacaataaaatgaggcacacgaatatttttggttccccagtgcattaaatgttatgtttacactctactatcatctgtcaagtgtgcaatagcattgtatctaaaaaatgtacataccttaatttgaaaatacattactcctaaaaaaaatggtaacaatcatctgagcctgcagggagtcataatctttttgctggtacaggctcttgcctcagtgaggatggctgctgattgatcagggtggcggttgctgaaggtcgggatggctgtagcaatttcttaaaataagacaacaacgaagtttgctgcatcgattggctctcctttatagccaatgatttctttgtagcatgtgatgctgtttgatagcattttactcagtagaacttctttcaaaatttgagtcaatcttctcaaaccctgatgctaatttatcaactaagtttatggaatattctaaatcctttgttgtcatttcaacaatgttcacagcatcatcaccaagagtagagtgcatctcatgaaaccacaatctttgctcatccataagcagcaactctggatccgctgaagttttaccttgagattacagctattcagtcacaccttctgactccacttctcattctggttctcatgctatttctaccacatctgcagtgacttcttctactgaagtcttggaccctcaaagtcattgatgagtgttggaattaactacttccaaactcctgataatgttgatattttgacctcctcccctcaatcatgaattttcttcatggcatctggaatggtgaggactttccgttttcagtttactttatccagatccatcagtggactcaccacaatatagcagctatacctttatgaaatgtatgatttaagtaataagacttgaaagttgaagtgacttcttgatccaaggactgcagaatggatgttgtgttagcaggtatgaaaataaaatcattctctttggacatattcctcagggctcttgggtgaccagggacattgtcaaagagcagtaatattttgaaagacacatttttttgagaagtaggtctcaacagagggctcaaaatgttcatcaaaccatgctgtaaagagatgtgcagtcatctagtctttgttgtttgatttacagagcataggcagactagatctagcataacctgaagggccctaggatttttggaatggtaaacgagcactggcttcaactgaaagtcaccagttgcattagcccctcacaagacagtcagcctgtcctttgaacttttgaagccaggcattgacttctctctagctatgaaagtcctagatggcatccttttccaatagaaggctgtttcgtctatattgaaaatgtgttgtttagtattgccacctttattaacttagatgttagtttgatcttctggatagtttgctgcagcttctccatcagcacttgttgctctgccttgcacttttatgttatagagagggcttattcattaaggctcatgaacatacttctgctagcttccaacttttctgctgcagcttcctcacctctctcggcattcacagaattgcagagaattagtcctttgctttagattagccttttgcttaagataatggtgtggctgttttgatcctctatccagaccactaagacattctccatattaaaaataaggccgttccactttcttattcctgtgttcaacagagtagcacttttaattttcttcaagaacgtttcctttgcattcacaacttggccaactggcacaagaggtctggctttcagcctgtcttggcttttgacatgccttcctcaccaatcttaatcatttctgacttttgatttaaagtgacaaacatgtgactcttttttttcccatgaacacttagaggacattgtagggttactgactggcataatttcaatattgttgtgtctcagggaatagggaggcccaaggagaggaagagagatgagggaatggctgatcagtggagtagccagaacacacaaaacattgattgattaagtttgccatcttatgaaaataagtaatgggaaaaggactctgtatttaagacatgatgctgggatggctggttagccatatgcagaagaatgcaactggaccccctccttacaccatatacaaaaattaactcaagatggaataaaggtttaaacattagatctcaaattataagaatcctataagaaagcctaggaaacaccactctggacatcagacttgggaaagaatttataactaagtcctcaaaagcaattataacaaaaccaaaaattgacaagtggaacttaattaaactaaagagctcttcacagtgaaagaatttatcaacagagtaaacagacagtctacagaataagagaatatatttgcaaactatgcatctgacaaaggtctaatattcagaatctatagggaacttaaacaattcaacaagtcaaaaacaaataaccccatcaaaaaaaatgggcaaaagacataaacagacactactcaaaagaagacatacaagtggccaacaaacatgaaaaaatgctccacatcactcaacatcagagaaatgcaaatcaaaaccacaacgagataccgtctcacaccattcatactggctattattaaaaagtcaaaaaaatgacagatgctgctgacgctgtagagaagagggaactctgatacactgttgctgggaatgcaaattagttcagccacagtgaaacagtttgaagatttctcaaaggacttaaaacacaactatcgttcaacctagtgatcccattactgggcatatagcccaaataaaacaaattgctttactaaaaaaccacatgtattctcatcctcatttcagcactattcacaatagcaaaggtatgaagtcagcctaggtgcccatcagtggcagactggagaaagaaaatacggtgcatatacaccatggaatactatgcagccataaaaaagaacaaaatcatgtcctttgcagcaacatggatgcagctggaggccattattctaagtgaattaatgcagaaacacaataccaaataccacgtgttctcatgtggagctaaacagtgcgttgtcatggacataatgatggcaacaatagaaacggaggactactagagtggggagggagggaaacaagggttgaaaaactaactatcggttactatgctcagtacctgggtgacagtatcatttgtactccaaacctcggcatcatgtaatatatcaaggtaataaacctacacatgtactccctgaatctaaaatcaaagttgaaaaaatgtttgtctttttttttttttccacacagggtcttgctctgtcattctggctggagggcactggagtgaacatggcttactgccgccttgacctcctgggctcaagtgatcctcctgtgtcagcctcccatgcagctggcagggctccttacagccatgtgccaccatgcccagttaatttttctacatatatattttaaagacagggtctcactttgtttcccagactggtctcaaacttctgggctaacacgatcctcctgccttggcctcccaaagtgttaggattacaggtgtgagccactgcaccccacaaagtttgccatctcatatgagtgcagttcatgacatctcaaaacaattacaatagtaacatcaaaggtcactgatcacagatcataacaaatataataataataataatgtttgaaatattgagcaaattaccaaaacgtgacacagagacgtaaagcgagcacatgctgttggaaaaattgtgcccgacggacttgctcaatgcagccttgccacaaactttcaatttacaaaaagtgaaatatctgcaaagtgcaataaagtgaaacccaataaaacgagatacgcatgtacatatttggggattattactcctcaattttttcagtattaatttcttgttctaccttgaataacatcattttggaatccttcgaacttccacttatcaagacgaattctcttgtccctattcagaggaatctatacagcaaattgaatcataagtgtactaaaataccaaagcagaagataaattacaagacatgaatagtgaaatgtaactatttgagggcattatttgtaatagtttgcctggtacatactcctcctaattttgcatcctaaagatactatccaaagactgtagaaattccagatacaagaggctagagttgacaggtaattaagctttggtcaatcaaagagctagaaaatatttattgaaataattgtatgcataacacatcacagtagggaatgtgcctcatggatgacatgaaagagactctctagtgaaataattgaacttgtgatgaactttcaatgcagttggggaggtgaccttcaggccagcccatgcatgctcgcacacgcagttacccaataatagaagacaatatgtaaatgacaaacgtaatagtctacagaccacatatcctaccctaatgggattctgagagatgggattttatatgggaccaggttcagggaaggtgccatagaggaacagcaacatgaactgtaacttagaggatgaactcaattaataatgacctaatgggagaaggaatttcaggacaaggagtagctttaaaactaaagtgtagaagtcagaatacagcagagtggttgagaaagagtgggaagggcagctgtgtaattagttagcagaattacgatggctgtgatcaagttgagaagggaagctggggccagaatgtgagggctcagaacactagatgcccaaataaggacatcatgttgaaggccatgggaaatcatcagaggtttgagagcagaagaatgccacaataaaagtggcatgttagaaatattaacctcgtacaactgcatccaatgtcccttccaagaaagaaatggaaaattaaattgcagtaacccaagaaaagcctcttgtatctcctctttgattaaatgtcctgtcatgaaaacatgtaaaacatttctaatttaccttcatgcatctttttaagaagaatataataactccactgcacacaaggaacataaattcaaccccattgcttgtaaaaactgtcccaaagaattattaaacaaatttgctgattctacttgtaatattatattttactatataggggtaaaaagggattgtagtttcagtttagaaaaaaggtaaacattcagaatgttttgttaaattcttacattcctactctaaaggataaacagagactttcagagtgtgagaagaaattgagatctctctggaaatacaacttcaaggattattatcagtgataagaagtattaacatatgttatgatgtcacattttgtgaatataacttttcaatgcccttaatacgtattgctgcactagacctgatatttttctttgggaaataagtcttcaggtagtactcctatttctaggaaaggagtactggggtattgtgctcatctgttcaaaaataaaagtcaaagctaacaaaacatttgttaaaaatgcattcaaccttttcacgttttaaaaacattttgaagatattattcatttaagtactgaaacaaaaccatgctttttatttctaacggcagccatcaataaactgaggcaaagcaagagatgttaccattcgctgatactacctgtagatgggaagtgaagtgaagaaatgagtgattatctagaggcgattacactcatgaacacagttaatcagaataattcaagccccctaaccctcttctgctgtcttcacatggtagatgtgaaatttgaattatcaaaataattggcacagctgttcaattcatgtttcccatatagggatagaatcaggctcagtttattcagctataaagtggagataattacattcatataaaccactcttgtgtgattaaagcaatgaatctatttataagaattcaaataccttaggtagaaattagtcaaatatggctagtccaggtttctttacagtaacagcaattaagacatatgttatatagaatatatttaatccatgaggtttcagccttctgattttgccaaattctgagtgctacaaagtgaagatacatatggatggtgaacaaccatgtgttcaccttaaacaatgctatattaatggcttggaaatccttgtgagttttacaaataagtgtgaaacaggagtgcatgtgtgtatgtgtgcatgtgtctgtgagcactcacacagacaacatccgaatggagaagagaggtatgaataaatatatatcctaaatttgcatcaaaatggtgtaatggttacctttggacgtacatataaggggaaaaagtgcttaacaactaggtctcattcttcaaaataaacaacatcctttgtacattttctcagcagttgtctgggagatcaacattaatctatttcttctcagaacttatatgactgggaaaaagataaaaatctgcccttgattgggtgctatgtgtttaagctctggtttagctgtaaatcatttgtgaagatcatttcttggtaggtgagtggaattgctattatagagtgttaatatacttgcagtgaagtgttgctgggggtaggaggtgttagacattgatcaggagcttaagagatgagctatttatttttgctgttgtaagagcaaatttctataataaaacaatgattctgcttctctgtcaaaaaacaccattttatgacatgaaagctctcttcagtaaacaaagaacagactgttattggagaacgtaaaaattacaatagaatatatttccctataggagcacagtggcctttaactcagctggaacttacagtatgacagcttttaaaggaagggacatattctatggggaggattttagacatacttgtctattccctaggccgtactaattcttatcatataaaaatgggtctacattagcacatggtgccagtatatcacacacttgcactgcggcatgaaaggagcccagcttgagggggagaactgctttctgtggcatagttccaagcaaacacatggcacaaatgaagccgattctgaggaatatggaaactttatgtactgtttgatagggaaatgtgcacagcttctaaacggtgagcttctagttctgctccaagaacaagtacaatcaattcttaagtggtttctgtaatgttgtgttcctaaccgagctgtttacattatagggaagtgttaagtttaattttctgttttattaggcaggtttctcattatgaacaataatttcaataccttttaagtaatttaaaaataagcagtaatccctgcagaaaggctgcagtaccatttctctagtgattcctttttctgtgttttatttgtataaggtgagcaaaattgcttattctttgttgcctcagagactttagtggcatgaggctaggcagagacaaaaactgataatcataaataaatcaacactattgggtggttccaatatccagtatctcaatgttctctgccctttgtctctttctgctatattaatgatctgtcttaattttacaagttttctgtaagatagtagacagaataggtgttactgaggtgaaggcttcaatccaaactacaaaactaggtagcctagaggcaacagctaattccatgcttttggttcacaaaggaatgctaatacacacaagtaataacaaaacaaactcacagtacatgtgctactgaagaggtgttgggagcattaaatattcgtacaaagggcagcacaaaatgggaggttaaaaaattaagcaacattaggaacctgagagatgcaactaattaaccagtttggccttaataaatatccatgctgtaatattttaatagtaatatctgcccctaatatctatccatttatgtaatattccccattactatctactcaaatgttctgctacactttctcgtaaaggtcagtgactctccactgccttacaattcaaactcctacagcgtagcaattactacaacaagagtaataactagttattgtgcttttcctatgtgctagatattgcacatgggatggatttgatttgtaattatgtgctagatattgtacataggaaaagcacaatatatattaacttacagacaccatttgaggtaggttaataatgaccacccctcaatggttctgtacttacacccttttatagacaaggaaaatgaagcacggaatgaagcataatttgcccaaggtcaccaagctaaaaggtggtgaaggtggaataaaatggcccatatcctccttttccagtgtttttctcttttacatcgtaactacaatttcgtaagcagctataatgtagccgaagctgggctagatgctttatagtcatcatttaatcccaacaacaactctacctagctgggtactatattcatttttttacacatgaggaaataagcacagaaaagattaccaacttccccaaagacagccagccagttaggatcaggatagcatttgtttgtttctttttttaattattttgagattttattattattattattattatactttaagttttagggtacatgtgcacaatgtgcaggttagttacatatgtatacatgtgccatgctggcacgctgcacccactaacccgtcatctagcattaggtatatctcccaatgccatccctcccccctccccccaccccacaacagtccccagagtgtgatgttccccttcctgtgtccatgtgttctcattgttcaattcccacctatgaatgagaatatgcggtgtttggttttttgttcttgcaatagtttactgagaatgatgatttccaatttcatccatgtccctacaaaggacatgaactcatccttttttatggctgcatagtattccatggtgtatatgtgccacattttcttaatccagtctatcattgttggacatttgggttggttccaagtctttgctattgtaaatagtgcctcaataaacatacatgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaagagtgttcctatttctccacatcctctccagcacctgttgtttcctgactttttaatgattgccattctaactggtgtgagatggtatctcattgtggttttgatttgcatttctctgatggccagtgatggtgagcattttttcatgtgtcttttggctgcataaatgtcttcttttgagaagtgtctgttcatgtccttcgcccacttttggatggggttgtttgtttttttcttgtaaatttgttggagttcattgtagattctggatattagctctttgtcagataagcaggttgcgaaaattttctcccatgttgtaggttgcctgttcactctgatggtagtttcttttgctgtgcagaagctctttagtttagttagatcccatttgtcaattttggcttttgttgcccttgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagtggtagatatgcggcgttacttctgagggctctgttctgttccattgatctatatgtctgttttggtaccagtaccatgctgttttggttactgtagccttgtactatagaagcattccctttgaaaactggcacaagacagggatgccctctctcaccactcctattcaacatagtgttggaagttctggccagggcaatcaggcaggagaaggaaataaagggtattcaattaggagaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttatacaccaacgacagacaaacagagagccaaatcatgagtgaactcccattcacaattgcttcaaagagaataaaatacctaggaatccaacttacaagcgatgtgaaggacctcttcaaggagaactacaaaccactgctcaaggaaataaaagaggacacaaacaaatggaagaacattccgtgctcatgggtaggaagaatcaatatcgtgtaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacgctacctgacttcaaactatactaaaggatagcatttgaactcaggtctttctgactcctaagtctagccctgtccacatgtcataaggtctcttcccaagcaactctgcttcctattctaacacttattccttactttcctgcctctgtgactctggttctcatgccaccaaatccatcaacacttccttgcagtcctgtttctaaaatagaattcagtgggttaaacaaatcatgattttaaaaagcagaagggaaaactacacaattggcttgcttctcctcatctttctctaacttcatttccagctggacacttttccctttttgttctgctttattattatttcacacaaatacattcagatttgtcaccttttgttctaatgctggaaatacaaattcatatggctaaaacggagtggaccatgacattgcccccagaccccacttttattccttgtaattaagaaaaaataaaccttaataagaagcttgtattaaaattgtgcaaagttagtcattactaaatgttcatggctgtattagctgcctgtggctgttgtaacaaatgattacagacttaatggcttaaaacaacccaaatttattatcttacaattttggaggtccaaagtccaaaaaatgggtctcacaagctagaaacaatgtgttggcagagcttgcattccctctaagggatgtaggggaggattcttttccatgccttttccagcttttagagcctgcctgcatttcttggctcttggccctgtccttcatcttcaatgccagtagtgtagcatcttccaatctctcttttactctgcttgtatcatcacctccttctctcttaggaggactcttgtgattacattgggcgcactggggtaacccaggctatctctccgtgtcaagatttttaacttaaccacatctgttaatacaaagccttttgccatgtaaggtaacatattcacaggttcctgggattaggatatggacatctttggcgggggaggagtgggcattattaaacctttcacaatggttctgcatttacttagcatgagaagctgtttgtcacaatgtgacatactgacatacttcttcgggtgggttcggtactatgtgtcatcgacaagagttacagtatctcacaatctagaaagcacaggaggcaaaaaagcaaacaaaaaacaaccagtcataccaggctcctgtgtccttgtggcagacatggtttaaccaaaggcctccggaagtgggaaaggtgtattgttgggtctctttcaccctgtaaccaaaagaccatttgaattgaggtggaaactggagttcacaaaagcgttacattaaaaaaataataataaactgtgactccctgaggaaatcacagtgtttctgtttggtgacaagctgctcttcaggaatgaatcctataagaatttcagataaagctcttatcttttggggagtgaaggctgcaggaaaggctagggtattgccttctgggatgcagaaaaaccatcttccccttagctcagctttgttcattcaacttagttcttcccctccacacccactcataaacattaagccttcttcccagctgtcttcctctctctttttcatttttaaacttcatctactttttgaattcttttctctgcaacaactactactaaaatctgaaagcttcttctattgttaccatggagagggcaattttctcaacaagtaaaggaggtggtgcagagggagagggaagaactacatatgaaaattgaaagttagcctctgtgtcttttcaacaacatcaaattaaatcttttcacttccatacacaaaacaacaggaacacacagtgggtggcaaattcagcccagggatgtgaatgaatcagtaggctttgtgataatatgctgggggtgtgagggaggtggcgaggcagcccctcaatcctaaaacagaaaagtaatgaacaatgataactgatatagacaattactctgcagttgtttgaatatatgctgctttctatcattttcaggtaaatgaccttcagaatggcagtagatggatttctaagaaatcatgaaatacaaacatgtagacaaacaaagcaggcagaaggaagtaataagtttaaaaaatgaagtgctataagaactgagagagaaagattatcaatcctccctttttctttcttctattcttctctatacaagttatgaagtggaagaaaatacaaatataaaatcatctgatggtgaaacatcagtgagattttaattatatctagattttttaaatctcaaactaggaaaaatctgctgattcacaaacatgaaaatattttaaaagatcagagatatattaattctcatgttctaattctcctgacatgaaccatatatatgctttattctttctgatgattctgagaaaaatcaaattctgaatttttaaaatgatgatgttgcccaaattgtaataaatcaccatattttccaaagaaaaattctacacaattcctgtacataaattttgtgtggaaaggcttgtatcataagaataatcaaaggaaaagaactgcaaactagtagaagcataaatttaaaatgttgctgatgatgacatcgagtaaagatttgaagtgttaagtagcatgttaaccaactttttctatgatcctcttccccttctcaatacccactctagcttttaaaaacacaatgagattgttttctacagcacaatgatgaacatttcaggtgtataaaaaatataaagaaaagattacaagtgaagtctatggcatggctgtactaatccacacacacgtacgctcggcagtgtaaaagttacctcactgatttgcttgaattaacaatttaaaataaaattttatactgaattaatgtttatttttataaaatagcagtgttattagaaagatttctgacaagtagtgtacgattacaaatatcatctaccttggagttaccatgaaattaggagggtaaaaatagtaaataaagatcctattctagacatctggcctatatgcagacaaccaggcagcacaaactcaagagtccgcttgtaattgcttttgaattcagagaaaattaatggtaagttggttggtttacaacacacaattctcttatttgcaaagcaaaactgaaaaatacagatagatagccaggcagggaaaaagagagagagacagactgactcattaaaagagagagagagagacactgactctgatttataggatacttgcttatctattcctgttagaattttctgcttgccacttcacatagtatcaacaaaacgaatgtattacccccaaattacagactattaaataaagataaaaactaagatgattttcatgagaagtaaacaataagctttttacacagcacaaactgaggatttcattacacaaagttatgggaaaagctacatattgatatctttgttattgtgaatatctcagttattgtgaatctgtaaattccatgccctattacccccatacaagccagggagatgtactcgtataatagcatttcactcatgattgaattgacaccaaatggttgcctctttgcaatatatacaaagaaatttttagttgtgggctttgtgttttgttttgtagttagaccgctaaaaataatcaaatgtctgatatagttaagccataaagatgaaagaagtgtctcacttaaaatatttattaattacatatgtttttatatctataatatacttatattctgatgtgcaggaactcagttacttaagtcaggaattcacgtggggatagagttagaatttaatcagaaaggccagtctcctggggtgggttctaccagcatttgaactattttttatcacagtcaacactagaggccttgctaatgagcaaaatgaatattagaaatgagttttcacttatgagattagtgttacttaagatacatgctttggttaaaatatttgagagcaattcctcatctctagcttgctaggtataaaaatatagtaagttatggaacctgtattctttggaatggtgcccaagatttaatgcctaaactatgctttgtttccacattgaatccgaagattctagttgtctgatgccttctctaaggttaactgcatcctgcctctagattctggaatattctcatgtctcccttgattgaaccttttatacggagtatgacaacacctgagagtgagggtatgggagtgtagctaacctttacctattatactaaagttttgctgtggttatctaccaaaaataacctaatagttggccttgcataatagtgttgatctagggcaattcataacaccacgtaagccacaaattttaaaataacctccactataaggaagtgtaaccaactccttacattcaacaatacatttgactttattcttggagtatattattacatttttctttttatttcctcatggttatatttgttataaagcatggttttataactaggtcgttaaagatctttaaagattgtgttattttttgcatactattactatcatatgaataatttcacaatcttgccttgtctttcatcttgaggcacctattcacataattattttttcacagtccaaacaataaccaggccttgtaatttagttatgaaataaaaaggctggtatttacataatcgtcttatgagttatgcatgtgcaagaaatgttctgcatgtttgtgtgcgtgagagagacacagagagagagcgagagattgagagtaagcccgatcattattgaggggtgtaagaaattactttatggagatgcaaaaacctggggttcagatacgagactgcggtgagatcattgcctcccaccctctgggggctcatctgagctgccaaaatattctcctctctgacatttttatcttggctcttcgacaagttctcagttgcctgctcaagattcatattctctattatttcttccctgggtatctattttcacagaatagttgaagactcataataaagcctattttaatgtatcatttttcctaagcaaatccatttcaatctccactgtttttatttgccaaacatgtcctaaatactaattataaacgcagctcaatgcagtttattatgtttccacgtatttataccatatatgttattcgtgtatgtgtacacacacacacacacacacacacacgcgcatgcacgcgcacatatggtttgttgccaataaacctgtgatagaatctggcacttatcaatggcattgccttgggcaagtcacttaacctctctgagtttctccctttcaaaacaagaaaaacgccagttagcttgtaccacttttgagaggattagaaatattgaatatgatatgcatagcacaatgcctggtatatactagaaattaatgcatggtaagcatcatgaattttatggtagtatatatgacctaacattttgggccaaaaggaagtgtttgaaggcaatttggtcaaagccaaacactgtatgtttaaataatgatggttgggcaacaatgctatgtctttaagcatttctttccatttttcaaaatctgctctttcttattcacaattatttctactatttaatattttaatgggaagagttggataaacctaaatgtgcagcattgggattcttttcatagtgatcacttaaagtttgttttgctttttttttttaccttatatcaagaaataatatataaccaatacataattatatgaaaacatcgatctttaaaatagcataaataacatcaacaatccttccctatgtgtatataaaatattcatagatatatatgtggtgtgtgtttctaaaagtaatatatgtgtgtttgggtatataataaatattgcaacaaaaacaatatcatgtagtacatactggtttgaaggtgctctcctcactatactccaatttacacaccacaatctatttcagcatcccactaaattttgggcaatttaattttttcctgctagtccctatttgaaataatgagcttatctgtagtgaaaagctgtaaatatgctgcctagattcccctttggaaatgaaggacttagttccccagctgctaggagtgctgctggtagacagccttcagctgtcagcccttgtcttagtctgggccgctatagctaaataccttagactgggtaatttataaacaacagaatttattgcttatagttctggaggctgggaattccaagatcaagacatcagcagattcattgtctggtgagggcccactcctgttaaatggcatcttcggtgtgtccttacatggtgggagggcaaggaagctttctggagccgcttttataagggcactgatcctgtttctgaaggcagagcccgcatgacctaatcacccccccaaacccccaccttctaataccatcaccttgagtgttaggtttcaacatacacattttggagggacaaaaacattcagaccatagcagcccccttatggaaattcccgtggctaaagagaatcatcttgctaaagttcgttgccttcctggagtagcccacatccagtgcatgacttgacacggggttataaagatccagtcccctttcttcgtttcctagcacttctgaagggtcattccagcttaagaactccctgaacggtcagctgaggcccttactaagactgcgtcagagctcaacttctccctctgcccctacacgttgaccccaagaacactcctaaatagacatactgcatgctcacctcaatctcagggtatgcttcccagtcacccaaactatgatattatctttaagtaagtaaaccctaggcatttgggactgatttctagaatgctcttaatctaaaactctccaaagtgtaggtcaaaacttttccataatagtgtgcatattttctccccattgctcctttatcaagtacttgggaattaaggtaaagaatatttggaagaattaaagtggggtagacttcctgcatatctctcaggggtcaaacacacctgtttgtggccactgactttcgcaaaaccatctcatctttggccttgggcacactctgtcgtctgaacacctctcaacagaaggtgccctcctcactacactccaagacttccctttcaatccaactgaaaaatttgaatctattaagaaaatacgcttttttggaagctcttagaaaacaattacagtgaaacatgtttctctctctctctctctttttaaatttgtaccatcaattggaaaggggctttgagacactatactaccattgcccttttgattccctctcaaatttgaaagctttatttatgatgcaaaaatagccatcatgattaattggttttttcaagtgtctatcatttttcaccaaggataactgctatgattagcaagaagaacctccatacaaatctatttaatcatctaaaattcatatttgttttaaggatgactgttattttgactgataacgtaaaatactactatgatttcagcgcaaagttaaagtgtgaagaaaagtaatacagaggttggcataaccatcaaagggaatttcttaaagaatatagaacaaattcaactacagagtagagatttattatttactaagatcttaaaacatgctttttaaattctgataacgaaaatatgacatagagtttgctatcctagttttacagttgaacaaactgtaatagaatagatcctaaaatttgtgcaggttgtcaataacatacagggcaaggttttagatgcctgactttaaacaaagctcatgctatttctacaaatacaagaaaaccagaaaaaaatattcacatagtcttaaagcttctctatatttcaggagggggtgaagtaactgaattatattaacagtgttctttaccatgatacccaattcttgtcatgaataaaaggtgatgttcagagatgtcatcaaataattgacaaaaaaaaaaaaaaggataagaaaaaaggaatgaaataaggtagtgaccaaaccttccctttttatcagtgatcaaaatccttgcttttacatatttataaaatccattctatttctctggatgtgtaatgaaagaaaatgaatatgtatgttcatttctaatccatttgaaataacaaaagagatggcattctgagtccacattctctttccagattttaagttttataattacttacgtaacactatcaacgaataggacaatagaatacaaacaaaaagtgaatcctttttagaagacagtttgagtacaaactgctatatattatgtactactctttaaagctctcatgcagattttaataattaatcaatattctaaatataaattactatatgtaaagcagtaatctatttttataaataaaatgatttcgtagaatgctgtgttaaattctttccctcagacagttgctctagagaaggaatggctgcttggaccctggtaggtacatcatggtgagaggcacaaatgttatcctggtaacaacttcacaaattatagacatagtgcgaagagaaaagatttctaaaagattaatttggtaaaagcatatgtagagaaatcaagtgactcagagggacatacacatccaactaagataatgttctctcagctgtgctcctcaagatgctctacacaaatggtttccatggagaaatcactgagaaatactgagctaacaatactaacattcctaaaagacttttcagtgaccttactatggagatgtacatcatagattgctaggataggcaacgtctatgcatgtttttcagcttatttgaccttttcatgaggatcatgtatgaacacctgatgaacctggttttctgtaggacaattttggaaatgttgagatcttttatcaactagaaatgatagtatatttcctagtcaaaatattttttaaccactttattgatttcttaaccactttattgacataaaaagctatacacatttaatgaacacagcttgatgagtttcgagataattacagttatgtgctgcataaggacattttgatcaatggaccactatcatgtgcacagtctgtatacatgtaggacagtggtcctataagattataatatttttctgtaacttttctatgtttagatgtgattagatacacaaatacttgccatcgtgttccaattgcctgaagtattcagtacagtcacatgctgtactggtttatagcctaggagcaataggctataccatacaacctagatgtatagtaggatgtaccatctaggtttgtgtaagtacactgtatgatgtttgcacaacaagatcaatcagctaaccatgcatttctccgaatgtatatctgttgttgagcaatgcatgactgtatacccctgtgaaatcatgtccagaatctatgccataaacctatgcatcacctccaaaatttttctcttaccttccttatttactattatttttgcatgtacgataataacaggtaaaaaaagatttactctcttagcaaagttttaaatataaaacattgttaactacaagccctaggctgtacagatttgtaggacttattcatctcatatgactgaaacctagttagtattttttttttttttttttttgagatggagtcttgctctgtcgcccaggctggagtgcagtagcctcccgagtagctgggaccacaggcacccaccaccacgcctggctaattttttgtatttttagtagagacgtggtttcaccgtgttagccaggatggtctcaatcttctgacctcgtgatccgcccgcctcatcctcccaaagtgctgggattacaggcgtgagccaccgcgcctggcccctagttagtatcttaatactcattattttccattttaacggcacaaaacagctgagattatgagagacaagagtggttattcttattagaacaaccatagaaggagggcaatatctacaagtttgggccatggggtggtgctgctatgaatagactacgaatggccatgtaaatattggggtttgtgacaaaagataggaaagcctatctcaagaaggaaaaaaaagtgttacaagaaaggcaacattggtaaggaagaaaaacttgatctttaaaacatgttattctaaacagactatattacttgttttcttgtttgattatcattgctagaactggtaatgtttttattgctcagtgtatactttctcttgaactcagtgggtttatttgggtcttaataattcagaatataaaaactgatgacctaataccacgtatattgatgctaacggacatgtttagaatttgtcagactatgtaagctattatgaaagttactgctttctctttctccaacataaaaatattcagaggcagaaagatagacatgaataatagagttttttctccattttatttccttgatttctgaaacaaatttaaacagaactaagaagacaggaaaacaatcacatcatatttagctaagttaaaactgcttatgtccaaagaagaaaaatgtgcattattaagagtatcttggctagcatagccagctgcctatccgataccctttctttccttcttagctaaaaaaatccaaattctgttcagactagcaaggttttataactaagttaccaattttcacattttgaattatgaagaaagaaacacacctattcagttaaaacactcaatcctcccaagatccttagaagttaggaatggtcacgtgacacatttctggttaatgcactgttcaagtagaaactcttctgtgtggggctgccagaaaagcactggttttccttacaaacaggagctgacacagctggaatatgcttttactttccccattttcccttcttccattttaaagtacagacatagtgcctggaggcagagtagccatgttgagaccacaggaaaaaaagtcttgctgggcacggtggctcacgcctgtaatcccaccactttgggaggctgaggcaggcagatcatgaggtcaggagatcgagaccatcctggccaacatggtgaaaccccgtctctactaaaaatacaaaaattagctgggcgtggtggtgcgttcccgtaatcccagctactcaggaggctgaggcaggagaatcccttgaaccagggagtcagaggttgcagtgagtcgagatcgcgccactgcactccagcctggcgacagagactccatctcaaaacaaaaacaaaaacaaaaacaacaaaacaaaacaaaaagaaagtctcatgttggagatgactggggttggaggaaaaagttgggacatacggttttggaggtgctgcactgaccctggaacacataattctggaagtcttgctctatgagaaaaagaaactatctggataagccactgtagtgagaatgctgtcacgcatagctaaacacaatcttaacagagtaaactggaaaaaaaaaatcctttaatttctaaaattcttagagtgtctaaaattatgattgtttttgcatcgatgcagtaaatttaattctcaggagactttcattcatcattgaccaaaacaagacatgaatcatattgcatttaacagttaagataaacatatatatgaatatagctctataaaatgttgtcatattccaaatactaagtaaaactagtaatctgtgaagataaagtaaatcaacaatatttataaagcacctagtacatctttagcggctatgtcaaatagaatattacaccttcctttacaggaaatttaaatttatttcgaggaccagaaaataacaatctaaaaagtcaaatgacaacatacatttgaaaagaaaagttcaagacaacagaagcagctttacaagaaaatatatagttaaaggacaaaatgattttggactgaatcattgatgaaaaagaccaatacatattggcagccgggcacggtggctcacgcctgtaatccccgcactttgggaggccaaggcaggtggatcatgaggtcaggtatttgagaccagcctggccaccatagtgaaaccccatctctactaaaaataaaaaaaattagccgggtgtggtggtgagtgcctgtaatcccagctactcaggaggctgaagcaggagaatcgcttgaacctaggtggcggaggttgcagtgagccgagatcgtgccactgcactccagcccgggcaacagtgcgagactccatctcaaaaaaacaaaacaaaaacaaaaacaaaacaaaacaaaaacgaccagtacatactggaattaacaaaacaacctttacagaaaaggcaggaataaatctcaaaggcttcaagctgtgacataccagtcaactatataatcattatattaatcaactttaaggagtgtgaagaaaccttaagtcattggtatggttaataattggatttggtcagaactcacaccttgaatgtttgcatggtcctcacctacaaagtttccaaatgttaaaataaaatatatcctcatttttatttatttattattttagttttatattttattcttttttagaaatggagttttgttccattgcccaggttggaatccagtggcgctatcatagctcactgcagcctcgaactcctgggcccaagagatcatgtcacctcagcctcctgagtagctaaggctacaagcccacaccatcacagccagctaactttttatttcatttttttgtagagatgaagtctcactctgttgcccaggttgctcttgaacttctggcctcaagggatcctccatcctggcactgatattacaagtgtgagccattgtgtctggacccgtcctcattttcatttagaaaacaattgtactgtaaaatctcattatatatagcttcttgcctgcttgcattctttccaactactgatctttgcccccagtaaatgtcctcttctagtgcctaacatctattacataacttaaaaaaatcaaacttgagtaagtgtggtaaagtggcaggctaatttttatgtagaatttctcagaggggacttctgattctatctgtggaagcatttcattactttcgtataatataacatgacagaaagcttagcctcaatgaagttgctacaggttattttccctctcactacaatctacttctttcacatttagggaaaaaatatgggattaagagtaaattactctctccaaattactctctcctctccactttcttaagtatagaatcaactcaatttatctatatgcttttggcaaaaatcgtcttcatggatttaattttttttaatttctagtttgagtgttcaaaaataattctggagttgaacatagattaacttgatatgggggaggggttacattggtcattacagtttattttgcttccataattgaagagagaagatgacagttaaatcaaagcatttctgttcttgaaataaataatacagtatatattcttttcttgaataaatcataggagatatataattcttaaatattatgtcacttgtttacacagaatataaaatataaaggtaagggaactgaaagcatttgtgaattactaaaattgtattcaaagttatttttataaatcgaataagaaattgactcaaatcattttagaaaccgtggcattatttttaatgaattctttaaaaatcataaaagcacaatcaaatcctgttgctttttttttttcaaaaacaatgcagccattactaccttggaaattactgatcaattcatttatgaaatttaaaaacattaaaacatatgcaaaaatcaactttcactcccaagttattgaataaaaatcaacaagatccctggaaagataaacatagcttaattttcatctatatgaaaaaggcaggcacatatttagaataagaaatcacaattgatcagttgatttattcattctaatacatatatgattgaaaccaccataacacttttttcttttgtggccatgactgccctatcttttatgtttttcttatagaggatacactctaaaattagggcctatccctttttaatttttgttccctaagagcagataacactgatgcctttcaccagcaagtgttcaataaataacagatgaatgtaaactcagtattgtatcaaaagctcttaaaagacagtcaatatatttctaaagaatctttatgacactgtaactcgaggtatcaaaagtaagcacttgaaggaggaaagaaaatactagtagtatttaattacagactattaaaatatctacttaatgtatacgttaattttatataatatgtatcactttaacataagtaaccatatacataaaagtgtggatacaggtacagaaacacttttactaatagtgatgtgtgatcactgcctcatcttattcacacttattcactatcatacacaaggaaatcaaatttaaatccaaattattactctagtgtctctttctattctcctttcttaatagtcttcaacctgactctagagtgctttgtaacatgggtttcaaagacaatttgttgaacgaaggaatgaaaaaaacaaccatatacctaacattaacattagttaacattaccctaacattaaaggtaataataagaaaaatttacatcataacacactgtaacttcaattacagactttaaggaccaaaagttatggtgaaatggaaagcctaaaaggcaggtcctaaactttagggaacaataacattatataactttcagaaaattaaaaaaaaaccttattacattgctttcctgtaagaaagttagagaagacccagattctacgtatttctatgaaaacaataaaaatcactccatataaaggagccctaactagatccaagaaaggaaatttgtaaatagaattctctaattatttatttatttgagacggagtttcgctcttgttgcccaggctggagtgcaatggtgtgatctcggctcactgcaacatctgcctcccgggttcaagcgattctcctgcctcagcctcaggagtagctggggctacaggcatgcgccaccacgcccggctaattttgtatttttagtagagacggggtttctccatgttggtcaggctggtctcaaactcctgacctcaggtgatacacccgcctcagcctcccaaagtgctgggattacaggcgtgagctaccatgcccggcccagaattctctatttaaacacaatggcaaacataaacttccttatcagaatcccactggtattttatggaaaacacagtacagtgacttccatcagaattcatgtaaatatcctggatcagttttgcttgataagattttgacagaaaagtttacagtgaattgaattaaaatataataagatacacatttccattcatagactttgaaatgtgtagtttagtatagtttataagtttatgtagtttctttaagaaaaaagcatatggtatcattttccataaaaaggtaattaggagacttagaaaatatgattttgtgtgtgtgtgtgtgtgtgtgtgtgtgtttgcaactctatgacctttttatttaaggggcggtttatttttgttatgaccagagaatataaaataagtcacattactgacactgacatatctttacatccttcgttgaagataatagtggatttggtctcattaggtaaagaaagaaaattatataaatatggatcagtcatccagatggtcgcaagctgtctaccagagacatgtacatttgttggaagataattaaagcacaaaatttgtaaatatcttcagccaaacagattacaacattaatttcttaattaatttcttaattggtatttcttaaacaagtttgtgcagaaatgaaatgatgagatgagaagggctggattgttgatcgatgaaagagaaaaacagaataatcaatctcctcaccctaagatgactgtcacccaacctcgtgaaatccatttgatgcccatggaaataaaccatgtttgctttgttttgttataatttggatggagaaatgagatgtgtaagaagttgaggggggtggctgaggaaatagaaaagaagtaagaaacattatctattcccaagaggtctgggggtctgggtttatgttaggacaattacatttactaagtgactttagatcaattaactaaattgtctataacttctctcatttgttgaataagggaaactattgtaatagccactttctgctgggtttgtgacaacagaataaaaccaagaaacattctgttttgtattgcttttagtttaaatagccaatgccactttacccacacattgtcccatcaattcttccagggctatactacacaagttgtttagtaatcagattttgactgaatctattcaccaaaagttataatcagaattattctgtagctaattcaaatgctttttgtgtatagacagagttttaaaaaatcataatttttaagtactttgaccttaacaacaacaacaaaaattaaactcattcaagtaattatgtcccatttaaatatacactatacccactaaaactgctcattcaatttttagataatgaaatctcccaggtaacagtgcaatgtgtggttaaaaattaatcttgaacaatgctattatcatcttgtccagattggccaatttgtctcaaccccaatctggaaaggtcttactggaggataaaatgcctttgccaactcaattctttattcaatacaagtgcagtggttgagattttgtggtgaattatcctgaacacctggccaaacggaattgaaaaaaaagactacaattaactcagcacaggcaatcagacaccagtattatgaaaaataatatcatatggccatctaaattctatttgttgatagcaacactagtctccactgctgggaacctctcttcatatttccccctccacctttctccctcctgtctcccaccatccctcttccatttcctcctttcctcactcctcttttgtcctctttaatattcctttcttgtctttttttctttccttgctacctttcttttgtcttttctctctccttcccctttttcctgctttccttcctctcttccttctttttttccctttcctcctccttccttccctttctttcctcccttctttgttctctccttcctttccttaagggtcagatttagtaatcactctcaaagcaaaacccaggacatatttttcccttcatttgatagattatgtcaaaaaagaaaactgctaattcttgtcaaatattgttgtttcagagcaattttacttatgtttatgtgatgaaacagaaaaagcattttttaatcagatttctccgacactaagctataaagtacaaatcatccactgctattgattcacaattctagaaattaaactttgaacttcatgtgtgctttacttctaaaggcttaatttgcatatttcacatctctattcttctaaaagataatggtatattttctactgtctaaaatgaagcagatttgcttaatttttttaaatggctgtattcttaaaacttaaaaaaattaaagttgtaattgtagcttccatttttttcactgaatataattcacttagtaaaaattatttttatttcaaaatggaagcagctcaccattttctaaaataatactttaatcaagcaatacatactaaaggggaccataagcttttcaccaaatatgttttctgagttcaaagtctaaagctagtgaaaggttagcttacttgaatgtcatgtccttataccccttctgtggcaaatatttcaattactgcacgtctaaggtttggtctgaatctcataactaactttgccttgagtcataaaatgtctcattgcattatcttatctatcttctggtgctttggaattataatcctcacattccagtctttgttgaatatgaagtttccttatcacattgcattcacattatccatcaagctatccacatttattgagaaccaattactgtacgtgtcatggtcaaacaaatttatatttcaggtattggtatatgaatggtctttatttcaggtctacacgttgtgaagttgagtagatgaacctgttgctttagatcagctgtatccaatcttttggcttccctgggccacactggaagaagaattgtcctgggccacacataaaatacactaacactaatgatagctgatgagcaaaaaaaagtcacaaaaagtatctcatgttttaagaaagtttacaaatttgtgttgggccacattcaaagccatcctgggacgcatgtggctcacaggccatgagttgaacaagcttgctttagatcataataattacctcctacaaatctcctttatttgctctatcctccaacttattctacatgttcttgactgagttcagtggacaattattgtttagtggttggtcagaatcatttccttcttctattgtcaatagaacccagtttctattcaggagaattgcctttccctaattttgagactttgggaggagagggatttaaatcaaagttttctgctcccttctagctcatgtattaacatgtgacccaaacaaggtgaactggactctcttttaagactttaaaatttgaacagagttacacacaggatggagaaaagagagtatcacaaacagactggaatacttcttgctagccacatgcccagaaaggcatgctcagattctttttccttttgtaagttttgttccaatgcctttgtgctaattacagcacatttactttctgcctgatttaatcagagaatgatttctgttgcttgcatccagagagctctaattgataggcaactaaactatatgtgatgattttattttcctgtttacaatcctttcagagttgccactgcctgtaggccatcatcaaaattcctcagtctggcaacaaaggattcccattatttagccccagtcctctctattcaacctcatcaatttcttcctcatcatatacccttaacttcagccatatggaatcacaattcctctgatatactctgttttttttccacctcagtgaaaagcacagtctgttccctctgcctggattgcccttctcgttttatctagctaggtaattccaactcattctttaatgcctggcttaagtttttccttcttcaggaatatctcactagcatccattctctctcctggcttagttttccctgaagaaagccccaacagcatcacccacacaatatcagagaagttgaaaactatgaggtttaagggagaggactctggaaccaaactgcctgagttcacatctcatcattgtctttcttcctcgatctcaggcaggttattatccttactgtgcctctctatctacctcacagtaatgttgtaagcattaaagaattcacgtgaagtacttagatcaatgactggcatatcatatgtgttagctattatcctaaaatttatctctatcatagtgttattattttcttccttcaacctcttttacctgcacattctatgttgtacaactttatgtttcccaggtacttagtggcagctcaatagaagttggttaaaataataaaaatggataggtgttagtaaagtttttttcagtttataaagcccttttggaattttgcctaatttttcacacatcaaacattaaagttgggattgctttatttaaaactttacataaaattgatattgatttcctgaaattataacaaaatcctccccatacttacttatccttcttatttcccctctcacacacatttgtttaatgattatttagggccattttaccgacaatttggtgattgaggctataaaagccaagaactgacaatgtctttaagaattattttttaatataagaggaagaggcaggcaaagcatccccctattcagcaagcaagagaagggagattagatttttttataaatatgtaatatatgaacattacatatcattatatataatatgctatatatactattttaaaaatatttttatatataccatatataatttataaatcctgtatttttgtgtctcagaaatggcttttgatttttccccctaaatttttttttttctgagatggagtctcactctgtcactcagtctggagtgcaatggtgtgatctcagctcaatggaacctctggtccaggattcaagtgattctcctgcctcagcctccctagtagctgggattataggcatgggccaccacaccagctaatttttttattttcagtagagatggggtttggccatgttgaccaggctggtctcaaactcctgacctcaagtgatccacctgcctcagcctcccaaagcgctgggagtgcaggcgtgaaacattgcacctggccctctacattagtttttgacctatatttaaagacgatctctgtgagggggcatcaaatcagtagtcctttctgaaaaggacacatttatttagagaactctggagactactgagcacatcaatggcttccctaaatgctggactcacaaacccgtcacaaggaagtgtggactttctctcccaatctattatctggtaacttctgcaggaagctatgtcaatggtagactaggctacagaagcggaaacaagctctcatttccatataatattatgatgtgatatacagtttgcataatacaaatgccatcattggttagatttctagagttcgtggtggaaccaaatataattactaacatttgttcaatactagcagtaagcagtaagcaaggcaaagtgggaagcatttttcatgtaccaaccaacttaatcctgatgacaaactgcaaggcagatagtacaactatccccattttatagctagataaacttgggctcaggtaggcagaataacttactcaaggtcacacagcttgggagccaagctttgaacccagacaatgtaacttcaaaacctgggctttaaacattataaaatattgtttcctttggtaaataaaagtcctgggagtattatataactcaatatggtattgtaaaagaacgtacctcttgtttctgtatgtatcagtacatagcaaccataaaatgctcagcatagtgtctgacatagactacatctacatctacatacaaatcactaaatagtaactgcagttacagttattaccgcagcaatagtatgtattgcttgcagtacatatattacttgctacgtatactctctgcagtagcaagtaataacacaagcttaggaatcaaatggacttggatttgaatccttgttctgctacttactgggaatttgacatctatgagcctcagttactttttctgaaaaatgtggctataattactttttttaaagcagaagtaaaacaaattttaggtacatatatgtagtatttacatatatttatatacatccatatccataactatattgtgaatgtgaatgtgtactctgtatgctctgtactcagaataggaaacgaagatccagagatggcttgaccacaatcatcatttgcaaatggcactgaattcaggtcttctgtattcaagctcaaggcctttaaatgcaggttgtttactatcaaattacttttattcctatggaattggtgaagtttattttacaaagaaattccccttactctgtctgcctcacttcttgttttttcaaaaggtagtactttaatacctaaataccttcagcacaactttgtatttctttagaaaggcttgaaagctgttacaagtgaaaaaactttaatgtataacaattccaacattatttttcttaatcattcacaaatataaaagatatatagtatatttgatctagctaggtaaaccatatttacatcaatgtattctaatgtttctagttgatgtcataattttaccaaatggattacactgaggctgaaaaatgcactatttgtattaaaaacatgttcatttgaacatggcattgcataaatgccaactttaagatctagggtaattttaaatatcttatgttttgttacttttctctttttaagttatagctctctttcaattatccttatcattggagaaggcaaattggcacagacaacttagaagagtggataataatcaattcccagactattatatttgattctgcaatatgttgggctgcgtagtgccaaaacaaacagtttaaatgtaaatagctcagttgagtgacttatttggtataaaatagatttttaaaataccaggttgtttagtaaatttaactgagacaactattcttgtaaggtttctgcttttttttttttttttttttgtatatttcctttttaatgtatggctacttttgttatttgcattaatttatatccttgattatacttaggctgaatagtgagagtaatgtgtttgctgagagagaaacagttgcctaagaactggtgggaaatggtctaggagagtaaagtgattggtggaaaatcttcattttaaagaaaaacttctgccaacttttatcattttttctcataccttctgcttgatgatcatctcgttgatatcctcaaggtcacccaccatcaccctctgtgattttataacttgatcaagcagagaaagccagtcggtaagttctgtccaagcccggttgaaatctgccagagcaggtacctccaacatcaaggaagatggcatttctagtttggagatggcagtttccttagtaaccacaggttgtgtcaccagagtaacagtctgagtaggagctaaaatattttgggtttttgcaaaaaggaaaaaagaagaaaaagaaaaattagaaacacaagctaaagagccaatttcaataacaataagtcaaatttaattgaagagtaacaatttgagccaaactcttattcatgacattatatatctttttctaacaatgtggatactttgtttagcaatacatggtagaaaatgaaaagattcaaccttttcattaatatacatttaacaattttttaaaaaacgattttgctcattctcatgcctggacaagtaacttaagttaaataagccttctcagtaacaatcatatacattgtggaagtggtaaagaaaacaaaagttttcagaccttgccagggaaataaattttacttattttttttttattcaagaaaaaacaaaggcaaaacaagatgggataagatcttctttctgatttaaaattcccttgaataggaagtaaattaatttgaagctggaccctagggaaatcaaagccaatgaaacgttcttgtcttagctctgtattttatactgggagcagtttatcatatttttttctttttatttcagattgttagtaaactggccagcagtgaagaaaaaccaagatacaatattttcttaaaaatgcgagttagtagtttttctatttagacatgaaatactgtttcaaagtcattaaataaatcttaatatgaatagtgttggacactgtagagtaagtcagcctatggtaatggttaagatgcatagtactagaattaaaatgtctggtagacaatcctgttctctgccctaggaactctgggaccttggtaaagccacataacctctctaagtttcagttctaacatttgttcagtactagcaataagcagtaagcaaggcaaagtgggaagcatttttcatgtatttaccttaaaagaggaataataacagggtaaatgtcataagggcagttgtgtagattcagtgagtagtacaagcaatacacgtatgacaatgccagaaagagcagcataatcatcatcatcacaataatattattacagcgcctgacactatagtaggtgatcaatagtgttaggtattactgtttttataaacgcctggctagtaagaaacacagtgatgaacaactgtggtgagaaactggagataaggccccaaaatgtgaaatacttggggagtagtcagtcaaaagtccgtgtgtggccctatattgattgaagagggctgaacttgctggtgtgaattgatactaaataccaacacacagctgggttatcagaggtgagtggtgaggggaaggaatgcctaatcaagtttatagacaacagactcaagagcataatataaccagaagattggtggcaaaattattggactatgtagtttggaatgaaaggtttcaaggaaagctgcaaaagacatctcaacaggagactcacactggacaaccagtgaacgattctaagaatattaaaaaaaaatgagacattgaattttcattctgaggtagccaatcattaatttttatggctatgtaactgtgcttttaaggttgtctcctcattagagaagaagatgagtagaatggaagaatgtttcttgtctctcaagcttctcagggacaccaagagttttctatgaatgaaggaactaattttgatcaatgcagacagaaaaaaatagtgttttaattgtcagagagaataaaaaaatttgtgtcacgaaacaatgattgaaaggcagtaacagtgaggcaataaagaaaaagttttgtttctcaaagctatctgactactctgaggctctttctagaaagaattaaatgtaatgtaaagaagaaatagcattttgtgtcacagtccaggagaagaaatcatggaagcaaaaagatctagaaatcttaaaagggattccaggaaaggagctaaatatccagagaggatgcatgtgtgaggatgaaaagagagctaaattaaaatatcactgtaggaactaactgcagaacaccaggctgactggcaaatgtggatggagtgttcctaaaatagatacacaaggtatactgaggcaatatacagcaatttaggaggatttcaagcttatgggaagtgtcagaaaatgcttttttaaaaagtgacttattgaaaatttgaccctcaaataagagcagagacaagagattttttttttttctccagacttacttctgaccatgaaagaagtacctaatgaggtggaaatgatcatgtcacactaaatttcaataaagtgaaggatgaggaactagagaattatcagacttcaacaagcagaccactgtttcctgaaaagcacgtttggaaaaagacagaaaggaagaaggaaagaagaaagtcagggagggagggagggaggaaggagggagggagggagggagggaatctattgaaaagcaaggcaagacaaggcaggaaggcaggaaggaaggaagtcaggaagccaggcagtaagggaaggaaggaggaaggaatctattggaagtctattgaaaagcaaggccagggcctgagactcaaaaagagagaatggttcatgatgactaaatatgccattgggatgataaattagctgaagcatattcagaggatgatggagaggtctagcaatgcggccatccctgcgccagtcatgggcagataatctcatctatagacccgtcaggccagtatttctggtcttctcttctccagcatgcaccacctgaagaacatctatctgtacactgctgggaaagggaggggaaaccttatcagactttctcactgctctatctcttgcatcttgcacatgtcctggagtataggaggtgctcaattgattccctttgaatctaaagaaaagtcaatgtgcagtaagctctttagtgaacttagaggtcttctacatacaatgagtactaaaatttaacagccacccattagaatggaagaatggaggctagaacacaaaacatgcctaggtttttactagttaggtgattttagctattttcacgagaagataatggaggaagacccactgcttggagcagacaatgaaagatcaaatattaaagagagaaaatacagccagtcaatttatttgcccccaaccccacacacatacattttttttcctatcgaagggagaaaagcaggaaatagctctgaatcagaaagcagggtgtagaatatttaggctttctaggaccagattgttgtatttgaatccttgctctataattttttttttttttagctgtgtaactatagtcagatgacttaacctctctgaatctccatttactcctctgtaaagtggcgattataatagtacttccttcatagacaactggccttactttttcctaaatagacaatcttggaaaagtaatgttcactgacattggaggcatcttgaggtaaggaattatactatgcctgctacaatgaacatcttgaccctcaaaagttttcacctgtgtaactatgaaaacagtaccaatctaatggaattgtgttacggattttatgacatcatacatgtaagtcacctcctaggattgttctgactgtaagtacactatgtggatttttttcttcctctttttcctgcatttctcacacaatggttattggctcctcatgttctacattcgtatgggattttatgctctgtactctgaaccagatttgaccctccagacttacctctctccattctttccaggctcctccacacccatgtctattgtgcattctctcatgagcacaggccatttcaaacctgtgtcctttcatacgctttctatacttcttgaaaactttttctctcctgtttccagacaaaaatctcattttctctttaaatgtcaactctagatttctgtgttttggggaggaccagaataagaagtgtgtaactaaaatatctccatgaggaacagaattacacctttcttgtgggtcctaaacactttttagtctttaacgttttcttacttaaatctagttatcactaggaaggacaaaatcttgcaccactattaggttttggaggattttgaaagtgtctagaggatagctgatagtagttgagagttggattctaaagtcagaaactttgggtctcaaggaatatactttaaaacataaagaagcaagaggctaatcttcatcgacctctcacattagagccatttctgttcagaaaaacattacttaaaatattttatgttttctaaaaagacttgcctctggattcaggcatgtatatatttttttcattttttaatcaaagtgtttcaaaggacagaagttttgaagtcctgaaattttttttttttttttttttttttgagacagagtgttgctctgttgccaggctggagtgcagtggcgtgatctcagctcactgcaatctctgcctcgcgggttcaagcgattcccctgcctcagcctcctgagtatctgggactacaggcatttgccaccatgcccaactaattttttgtactttagtggagacggggtttcaccatgttggccaggatggtctcgatctcctgacctcgtgatctgcctgcctcggcctcccaaagtgctgggattacaggcatgagccaccatgcccggcctatttatcttattttattgtatatatcacattgattcttactgcactttcagatgcgtttacctttatctaacacatatgcggttctttcttttccaccatgtcatagtactagaaatatatgcaaatcacctttttcagtgaagtgtaggctggtcagatttgttagtggttttgtacagtctgagcaacctgttcacagttctaagggtcaggcagggtcgtattgttgtgccaaggatatttcctgttaagtcaatattttaaaagactgaaagaggatttgttttgctaagagtgcctgaatccataatctagaacgaacgggtaaagagttaggatatataaattattacatagaattttcaatgatgttctgggctgggtctcctgttgtcatccctaaggagcatgggaaatggcttcccctccagctggcggaaatcctttcccgtgtaccctatttaatcttaaccccaagtctgttcatgcctgggcattcaccccgtttcttatgcccctatcttgggttacaagaagctggctctggtattagctggttcagatctcagcctctctaaccacctcagagactaagggtattcttctcaagtccattggaggaattgtcttttcctgcctagggtccttactgaaaatagtctttctgatgttatgctattaaaggttcctccagtaacagatttgggtgggttttgtttgtttgttttttgctcaatcaccttatgccagaaccagatgtattacaatgtacaaaattaaactgtatatctaggtagacagatagatacacacattgtgtgtgtgtgtgtgtgtgtgtgtgtgtgtgtaaagagagacagacagagacagagcaagagagagagagggcatctgaatagtctgaggacatactatgtagcataatacctttctcatgcattcattagaaaattaaaatgactctactaaaattgtggttttccctccatagttaagcagacagaaaatcaagctcaaaatagttgaaatgaattgagtttggcacaccagaatggtagcatgaataacagtaggtgtaatatactattgcaaaccacagctttgctctgagtattttgttaattaaaaggtgttggctttaggaaggaactcttatttttttcaagtgtttgaagaacacttctctagtctgaaaatttaattggtttcaggggtacatgattagtcagactaacagctttacttagagctttaaaggagctactaaatcttttaaaacacacacacaatgtgtttggcatatttcctttgaagtattcacacatggttttcctgtaattcacaggtctcctttggttgataagaaagcaagaagcacatactctatttctagctttgttgaatgaatgtgggtaactttttttgtttgcttcacttttatatttgaaaaatcactcaacttacaaaataagttattgggctcacattaacaattctatgagagaatatctaaaaagtgctgttagatattcccttcctccttatcattccatgtcaacaggagagcaatgttatatgtgatcaaattgcattactatttaatactatggggtataagaaagattgttagcgacttccatctcactagtagataaaataactctcctccatgtaagcaacattggagaatattttctttttgaatatttgaaaggatggcatttggattaatgaattccgtaagaattcaagagaacttctgaagaaaatttgaaatcatgtctagattctaagaaagacaatctattgtgtaggtaaggaagaatttcatgtcttccctctaaatatttacagtctgcacatacaagttggaaaattagaaacaaacactatgaacacataaacacttatttttgtctgctttcttttctgtcactctaaagagtaaataaaatatatgacacacctaacatcaataattctcattttagaaaaataaatgcttgtactctacataggcaaggccggagtactggaactcaaggattcatgataaccatttgtatttctggatttaagaaaaaaaaatgttaagtttgggagctatggatttttaaagcttaatggtgctatttgcttacattttaatagattctttcttgctattaaaaatataatccaaataaatatttgctactacttacaagtaagataattgccaccaacactgccatcacccccatcatttactcagtgattcttatgtgctaggcaaggttcttcataaaccctcttttatttcacctttaccaaaccatcttcagggtagatgttatcatcccccttttaccaaggtaacgaaacttgttcaggatctcacattaacaagtgatgtttccaagacaatgtgcttaaccactgcacatatttctaagaatcataggacatcaggtatctttcttacatgtctcattcaatatgcaagaattattaatcactcaaatacttctaagagctatagcttataatatatggtatccatgaaatatatctaatatccattttaatttgggagagaagatcatttgatatagctataaaaatatggattgtaacaatcaagcgcatctggcatccactcacaacttaaatattacccttgagaaatatctccaacctgactttaaacatatccttccttcactaacttgaatagagaaataatcattgccttttcctgttttagttggcatcatctaagtgcccttctataactaacattatatgaattcatctacatgcgctcagtgaaaagcagggtttctcaatctcagcactattgacatttttgtcccagataattttttgtcgtgagtggctgtcctgtgcattgtaggatcagaattgcttgtcagtatctctggccagagctccctcctagatgtacaaccaaaaatgtctcctgacattaccaaatgtctcctgaggaaagaaaaattgcttatggttgagcatgtctcaattaaaaggattttccatctctccctacccacccacctctcaaatagctgcttagaatttgtgctggaaatcatttatgcctatccaattttttttttctcattcctcagaagtagaaattaagagaaattgttaagggcttctctttccaacatgatattgggcaggcactgaagtatccataagtaaaccacaaacttatggctgccaaggaataataaataatattacacaggaactgtcttagtgacaaaaatgacaacatctctgctggagagtaaatgtccacagattctcctcttgcatctacacttttgtcaagagatattccagattctcccattaagagccatagtctgtttctccactccttgaatatggattggtcaagtcacttgtttcggctaatgaggtatcagcaaacatgacataagcagaggcttaacaatgcttgggtgttgggctatgcttggaactcttccaccgctatggaactatgctagcctgatgaataattacaggcaagtgatcctgtcacccacaccgtctcaacttataaccaaaaagttataccagacatatgaatgccacatgtggtcatcaactaccagctgaccacgagtgcatgaatgagcacagctgagtctagcaaaagaatcgcctcgatgaaccaagccccaagcagaatcaagaatcatgagctaaaaaaaaaaaatgattcttattttaagtctctacatttggggtagcttgttacacagcaatagatagctgacacagcatccatttttacctgttaaacacttgtacgcaaaacaggatttaaaattcccttcccattaccacagaaattaaaagaaaaatgcttatccagcagagagaacacagctggaaaagacggagtctttaagttaaaatgtggaatggaattccacagagaatggaagattcacatagtcactctatgaggtcaataaatcaggcagccagcatttgacaggatatttgaagaaagtaacacttttagcagaaactcactattaatgcactaagacctttgtatatgaaaaaagtagagtatgtaataataagagccaagaagtaggcagcccagtgcagaagacaagggaagaaaaagccagatgaaaccataataaagaccacgctattgatgaagggtggtcatcaattgcaaaactgatatcagaataaaatccatataaccatttgagtataaccagctagagaacattgtgtagttcttattacagaaaatacactgctattctaccaaaattctgagcaccttaaaaaactcctgaattaaataatttattctgatttgggtttgtttattcaattttttaaaatagagttcctcctacctgaatgttagagacaagactctgcagtgaaaactaagcaaaatgaggtaagcagtgttttctacagaattcagtctaaatctcttatttgtttgggagagctacgttttcaccttaagcagaaaaataattagtgatgtgttttgaaagttgttatataatgaataagatcctctaccatgtgtcaggccctcacaagcctcatccaccagaggagatgataagctatttgagataagtatcagaatcatcttttccttcctcacaagaccaaaggtctgaaaaataacagggtctcaatcaaaatttgttgttgttttcacaattagaatgaggtgcaagttgcaatgtactaagcagagtccttaagtgtaatctcgttctctctctaaatatatatatgcatatgtatatatagtctaaatatatatatttagagagagacagagaagttatataaattaatataacagagttatgtaactgtgatttacagtttcctcagagtttcaatctagaacttcatcagtgagaaaaaagaggaaccattagtgcaatgtaaatgcgacaatattaaatagtcttaaaatgtagattcttttggttcaaatcaattataatatatttgcacaagatctggacagcataaaaatgcctttttagtcattttctgcattggttcctcatcataccactctggtgtggatagggaaaacatgattactatcaatttatagaacgggaaactaaattcagataaattaaaatacttcttcaagatcaacatttagtaaattagatgaaaggttctgagaaatctgtattttaagaagaaaggctctgaggtgagtaattaataaggaattcaccaaaaacaattaacctgattttaaaatgggcaaggatttaaatagacatttctccaaagaaaatatatacacagccaacaagcatctgaaaacatactcaacatcgtcaatcatcggggaaatgcaaatgaagaacgaaaaccacaatgagatattacctcacaaccatgaggatgaccacgatcataaacagaaaataacatgtgctggcaaggatgtggagaaactgaaacacttctgcattgttggtgggaatgtgaaaaggtgtagccactatggaaaaccgtatggaagttcctcaaaacataaaaatagaattatcatataatccagtcctcaaaaaataaaaatagaattatcatataatccagcaatcccatttctgggtgtacggttagtccccaacttactaaggtctaacttgtaatttttggactttacaatggtgtgaaagcgatatgcattcattaagaaaccatacttcaaattttgaattttgatcttttctagggctagtaaatatgcagtatgatactctcttctgacatattgggttgcagcatgatatttatcatgaggataaataattgatactctactatgtactgtgttgcaagatgattttgcccagatgtactgtaatctacatgttctgataacatttaaagtatgctagactaagcaatgatgtttggtagcttaggcatattaaattaatttttgacatgatattttcaacttatgatgggctgattgggatgtaatcccagtgtaaatcaatgagcatctgtatatccaaaagaattaaaaacaggatcttaaagagatatttgcacactcatattaactgcggcataattcacaatagccaaaaattgaagtaactaaaatgtccattgattgataaacggattaaaaaatgtggtataggacacaacggaatattattactcggccacaaaaaaagaaggaaatcctttcctatgctacaacatgggtgtaccttgaagacattatgctaagtgaaataagccagtcataaaatgacaaatactgcatgcttccttttatatgatgtatctaaagtagttaaactctttagagacagaaagtagagtggtcatattgccagtgctggggtacagggagcaatgggagctcttcagtgggtttggagtttcggatttgagagatgaaaacattctagagatctgttgaataacaatgtatgtatagttaacactactggtttgtacacataaaacagttaagctggcaaagtttgtattatgtgggttttgtttttcaaccacattttttaaattatactttaagttctgggatacatgtgcagaatgtacaggtttgctacgtaggtatacacgtgccatggtggtttgctgtacccatcaacccttcatctacattaggtatttctcctaacgttatccctccctctgccccccaatcccccaactggtgtgtgatgttcccctcccccatctccatgtgttctcatcgttcaactcccacttatgagtgagaacatgcggtgtttggttttctgttcctgtgttagtttgctgagaatgatggtttccagcttcatccatgtccttacaaaggacacgaacgcatccttttttatggctgcatagtattctatggtgtatatgtgccacattttctgtatccagtctattattgatggacatttgggttggttccaagtctttgctattgtaaacagtgctgcaacaaacgtacgtgtgcatgtgtctttacagtagaatgatttataatcctttgggtatatacccagtaatgggatggctgagttaaatggtatttctggttgtagatccttgaggaatcgccacacggtcttccacaatggttgaagtaattcacactcccaccaacagtgtaaaagcgttcctatttctccacatcctctccagcatctgttgtttcctgactttttaatgatcgcctttctaactgatgtgagatggtatctcattgcggttttgatttgcatttctctaatgaccagtgatgatgagctttttttcatgtgtcttttggccacataaatgtcttcttttgagaagagtctgtttatatccttcccccactttttgatggggttgtttgtttttttcttgtaaatttgattaaaccacattttattttaaaagggaattcatagaccaggtgaattgtggactttttaaaattcccttctgagttaaggagatttaaaagagatttttttgagtactataataaatatcatcctgtaaattccaatggttctgatatattaaggcccagtggaaaataatcgatttattttatgtcctcactactcctacttgcatcctcattgcaatatttgtggggtaagcagaatatgccagtgcctctctgtagtggatactgtaatgcttcatcaagatcctcttctggagtcgatgcacccacactaccaatattattcctagtatttgtggtgtggttgcattgactccagaataataatatctacaaaaggatcacagctgcatttctccctggtgcctgctcttggctagtgcaaagatacaaaagtctcgcccatttgcctcaatttggtagaactctgaaagaccatcccagctccagtgtccctgtcacatgggctgaagcctcagtagcaactgcagtgtggatgagcttttctctctgcccaatactgcctccttcacttccttataaatagcaacaatacttctcaaaatactttctgtgtgcaactttttgtctcagagactgttgccaaggaatctcatctctgacaccgtatctctggtctatttacgtaatagtttgtttttaatacatagaagtaatatgattttttcaggcattcgatagtagaatattttttaaagttaattataagccaggcgctgtggctcatgcctgtaataccagcactttgggaggctgaggtggtagaacacctgaggtccggagttcaaggccagcctgatcattatggtgaaaccctgtctctactaaaagtacaaaattagccaggcgtggtggtgcatggctgtaatcccagctacttgggaggctgaggcaggagaatcacttgaaactaagaggtggaggttgcagtgagctgagatcatgccattgcactccagcctgggagacaaagcaagaatcattctctaaataaataaataaaaagttaattatttattggtatcacatgttatataattcaattgaatgctctaaaaaatgacaaaaagtatgcagaggattgttggcatatttattgtttaagggcttataaagtagttttacactccttgggtatatttgagtttcaatgtatcatcagagttgctgtttcttatgtgaaatatgcacacttcctgtaactaaaagacccatgagcttgacaaattcaactgctgaagtcttgaactccgtcttcataatgaccttggaaatgtaactgctatcttaagttggtttgaagtgactgtattgaactaaacttgagttttaacgttctgggtcagtaaacatgttatgaattgcaggtatggaaaacacactaactgaaatagtggaactagctacatcaaaatcaatttatgtttttatttaacttgtagaaaaccatactatgcccagaagtgcgacaactaccaaccatacaaaagagatcaaaatcaaggggagaaaacaggtaacacttacgtaggaaaaattgcttgttagaagcacaacaaataaaaatttggtgtttgtttctttaagacatccctgccaaaccatctcaaattctttttgaacgtatgaaaggtaatcataaataaaacatggtttcagtggttttaaattatgctattgaaataacaatgttcctcagagcattagcatgacagttttgatgcacatacttcctattgtcttggacttgaatctcattgtcttaatccttttgatgaatgggtttaaaattaagagtgtaaagagtgtatggaaaagctgtgagcccacagtaaatggtttctgaagtagaaacatatccaactctgtttattcagaaagatctgtgaagctgtattattacagttgcttcattatgaacttatttttgctgcttacaaaggggaaatcccatcagatcagggctaagataattcctttttaaacaatcagtaaatcatatttaaaccttgtttacactagtactttttccatgatggcgttgttttacataaaatacatgctttcaatcttgttaaatttgttaggactcattttgtggcctaacatatgatctaccctgaagaattgtttcttgtgcacttgataagaatgtatattctcctgctgttagatgagatgtactgtatatgtctgctaggtctatttgatctaaagcataaagtccaatgcattcttattgattttttaatgtggattttctgtctattgttgaatttggggtagaagtcccctactattattgtactgtagtttgtctctttctttttatcactttatatttgctttatatatttaggtactccaatgttgggtgcatatatatttacaattgttataccttcttgatgaattgatccttttatcattatttaatgaccttctttgtgtctttttagtttttgatttttaaagcctattttgtctaatagaagtatggctatccccattctcttttggtttccatttgcatggaaaccaaaatatctttttctatctcttctatttcagtcaacatgtgtcctaaaagatgacgtgagtctcttatgggcagcatgtagttgagtcttgttgttttaatccatttggccactctatctttagactggtgaatttaatccatttacattcaaagtaaatattgataggtaggaatttactactgccatttaaaaagttgttttctaattgttttgtagatcctttgttctatatgcctttttttgttgtcttcttttatggtttgactgttttgctcagtagtatactttgattccttactttttaccttttgtatatctactataggtttttgcttttgctactataggtttttgcttttctttacatcttacgtaagggttttttaagctggtaataacttaactttgattgcatacaaaactctacacgcttacttccctaatccacattttgtaatttcaatgtcacaacctatatcttctttataatttgtctcttttaaccaattattgtagctataagcacattgggatgtgagagttctttttagtagagatcacacaaattttgcattttaaaatgttacttgaaaataaaattttcaatgaagttatatttaagattcaattattccaaggtaaagttaattacaaagtccagaatggaaaatcatgctatttttttcattagtagaaaaataataatccttaaaaatgatgtttcttttttcctaagatatctagataagaactaaaagtaaaatgtatttcctctactgtaaaattacaatctatattaatccattattttaaaacaaaaagatacgaagggagaaaatttttatcaagttatgttacaaaatctctagcttattgcatgaaattaaaccacataaaagaaataataaacctaactgaaacaacattaactcctatctagggtttatcaaactacagaaaacagaaaggaaaggaattatacatcttgagaaacataactactaaatactggtggaaactatacatgtgcatagttttgaattggtaaaattcttcatttttgccctgtaaatggtggaaagaatgaaaaaagtcactaaagctctgtttcctacttttgtactaattcaaaggcatgattatgctatacttaataactatttctacttaaaaattgttaatcattgtgattttaacacctaatgtatatattttctgtggaatacaagaacgtgaacagaggcaaagagctaggtagaaagaccaatttccaaagagaaagtagggttagtttactactgggggcctcacattcccattcaatctgacgtaaaagtggaattgaagggcatatgggctgaagttatcagagactgtattgctaaaatggataatcttcccctattgacaatgggggcctgtggctaccaaaattaggtgacttgaacagataaaaccataacaagttcggatcctttcatgcatctattttcaaaaatgatattttggtgattagtgaatcagatttattattatgataaaaatgagtaagtaaattatttataaaaacgtaagctatcaaaaacttagttttcagtgccatgaaaatataggttatagtaacttgtgaagatcttcaggaaggttaatttatactgtacattctaaaccatagatgctacatctggtaatattaagttgggaagggatttatctgggaaaacaccatcatttatcaattaaaccaaggcagaaaaggttgaatagtttgcccaaaacccccaaaccatagccaacaagagatcaaatgaggactagatcccaggtttattaattcccaatccagtgatcttttaacagtgcctggtttacaatatcatgagcatgcttctgaaatattaaaaatgttacgtctctatataataactttatatctagcatgcgtagattgagaaaaatagtgacaaaatcaacttattctgaattcagtaatattgtaatataattttgcatttattaattgcagtagcatctacatcacttaaaaaatgtctactacatgtttgtgggtaatgcatcactcctttgattcacagacaacacttgaggtggttgtggatttgagaatttctttcaatggtcctgggaaattttagctatatccagcacacaggttgagaacttctataatgttggtctctgccttgcaacattactcttaaccaaatatctttaaaagtcgtactctttactcttagagttgatttcagtttcattgttgccaaacaatgatatctcaatcatttgacaatgggttgtggcatagatataaaatatccaaattgtctaaatatttttatatttttttataaattagaaccaactaaaggttgtcaatataagagtactctcgcattccaaagtgcttttctgagtgagagagggtgcacagtcagaactagtgtgcttgaattttgctatttaacttcattcacctttacatatctgtagcccctgacatgaatatctatcttcaggcaagtgagtgaatattgccaacatctgtgatgatactggtaggatagggatgggggcaaaacaaaggttgaaaaatcctatatgaccatatccaatacctgaattctcttccactttacttacagaaagtgatttcccactgcttaccccaaaagtacacattgtgtcaaactagccagtctctttatgtaatacccaatatgctttcactctttacaaaataaatttatccttgttgtttcttagacttttttttgcacccattttattccttactaatgtctacgatcacaatcttctgtgaagtctttgttgacaactctagttaacccatacagtcttctttccaaactcctatgttgatttcagtcttacatatttatttatattattatttgctatctcaattgtaaaattctacaattggaaggaaattatggaaattccaatgctgaactttaaaatctttctcctttgagcattgtaaatcttagactgaaatgctttacatataatttagtagatgtttaatattctcaagaggtatgcctaagagtctttgcaaatcaaaaagcagatttatatgatctgatagtcttacttaggagttaagggattcatccctgcccagtagtttcccagtacatgaaattagtactggaggccttccttacatgttagaaccacccaattacccaataggatcaatgctattaaacacattagaaatcactacatatcatggacctttagaaagcaatattttatcacttcatatgagttatttagcttaggacaatgttttgccatttcttatttagattatgagaaatgtcacatctcattttaaaaattatttcttagtatatcacatcattctgattatctgcactaaagcaaaatcttccaaacataaaggagttttcaaaatatgttctaccattagaaattagcatgacggctgtattttcatttaacatattttacaaaaggaaataataggttcatgaatgagaaagctgttttctgtcgtgtctttgataatctgaatttagtctaacagaatagctttcatttaagtattattactgaataattactaacttagtaaagggtttatacctacttagtaacgaagcaggatatttccctgacccctttgtggaactcgcaacaggggtgccttatttacttagcccactgctctcaactcctcactggagggagtgtgcaagcaaacgaggtgggaactggagtgcatgagcactggagcagcatctaggtggaggcgtctgcgacccctgaagccccagagggtgtgttacagtgctctgttagctctgccatccacggacagcttaggcgttaacagctcagtgggccatttgtcttttcacaggaggcagctgccctccaccagcaagggcaaagggccttttgtattcacacttgtggctcctgagctcttgtccagcatctagggaaaatgaggtcacatgaacaaattgaaggattgtaaatgtgagggattgtactgccgatgaaagtggctctcagtgggaaggggagctgaaaaggggatgggggtggcaagtaatcttcccctgaagtccagccggattcttctctaaagttatgccatcaagttgtccctctgaagtcaagctgcttctctctgatgtccagctgtagtcctgtctaccagctgagtctggggtttttataggcacaggatggggtggggtggggccatgggtggtttagaaaaaggcaacattcgagcaggaaaactgggatataagttcccactttgagctgcggtttcaggctttttggcttgagggtggggttttcgctggggaccatcccttttctgcctagagcttctctgcctcctgccgctatcagtacgagagttgtgtaaatgcctatattgatacaggtgctcctcaacgtacaatgggattatttcctgataaacccatcatacgttgaaaacatcataaattgaaaaacccatcataagttgaaaacatcataaattgaaaaatgcatttaataaacctaacctactgaacatcattgcttagcctagcctaccttcaacatggtcagaacacttacattagcctacagttgggcaaaatcatctaacacaaagcctattttattaaaggtgttgaacatctcatgtaatttattgaatactgtattgaacatgaaaagcagaacagttgtatgagtacttgaagtatgatttctactgagtgcatattactttcacaccattgtaaaataaaaatatcctaagccgaaccattgtaaatcaaaacatttttagattgggaccctctgtatatttctttatttctcaggcccttgacaaaaggagataattgaagcattcttatttttattaaacagtgaacatatgtgctaacaaaggaaaattatattcagagaaatcagcacttgcccttgtattacacaggaagtgctaaaagctttactctttagagttaaatgctaagaaatttagattggtataggttacatacaagttttcccgacaattctatatcttgaaaaaaaaaatctaacattgtattatctgagactacagcacagttggactggtttagactaaaactagggtaagggaagtggtgttaaaattgattgaagattatagtatacgtctaaaatcttgggcatcattaataaagcccactctacttggacttattgctctattcatatcctttctgaaagataaactacctcaaaattcaggacccaatagtaatatactattattgcggagatgccatgaaacattcctggggctgtgatcgggatgattgagaggagcgctaaatgctgaaaagtggatgtgaccagggaatggcttagctgtttgccagtgtaaaaaataacttgatatcaacattaagcagcagctgaagaatcttttaatagtttaggcactttttctaaatccttcagttatgcttcaccgattaaattattaagaacctctgatctagctatttcatattttagatgtgagtgaagatgttttgaaatcattttcattgttcatggtttcttgttttttaaaattaaacctagaggacgctgagataatctctttttattaggtctgcagaaaccaagaatacaccaaatgctgaatagctgcatggaagtatcacttgccttgacaatattgtattatgataagctagttcctcttttttttttttttaagttgagctatatagattccaattaatgttgttaaaccaattgtttaaaaaatggccagaggcttctactggcttttagatggaggccaagatatgattgcgtcaaagatcaagataaggatcagaaacgaaatttaggaagagcctcccaatgtgaatgactaaattgtatatgattaacttttctaaaaatacttctcgttgtcatttagtttataaatagcttgcagataatattgtcttcctataggttcgttgaacaaatattaactgggtacctttgggcccagtgtcaccccaatggagtgaatattgttggtggcttaaacaacttccattcaaagatatccctacacccactctgaaattctgctttctaggagaattccaattgtcttcaagtttctacggaatccatcctcagttctggagatggatttagattcacctaaatcttcgattctaagccagtcaagataatctcatcctcttggttcaggaagaaaagtttaaatcaaccagcttatgaaaccattctgaatcatctttagtacaatagtagatatatatgaatacctaatacatatactaatgatacagtagatacacaattaaaattttgattgttcttatctgagggtgaaatctctgaatctgtgaggtaagtgtttatgtctctcactgtaacaagaaattatgttacccatttgttgctggcagtcatcttggaacctggagggcaactagtgaggaggtcaaagctgacgcagagaaaaaaatcaggacaaagaaagtcatagagaaagagtgacagagctctgcttgtacttcatctggagccagctttaacctctgaacttccagttatgtgagttgaattattcttatttttgaagccactttgaaagtgcattctctttcttgcagcccaaagcatcttaactattaaatatgtcaccagggtaacataaatatgccaacaattaatctcagtaaaatattatgatacttgctgaaataggagtaaattttaaaatgataatatggagagagaagcacatgcattcccctggaggactaagtaggaaaaaaggtacttacacaaataatattataaactgagaatgtaatggtaagtttaccaaagagcctattatgacaaatgtatttctagcaaaaggaagaatatatgttaaagtataaaggcagcaattggtgattagggagttacaaatagtttagtattacttgatttttcaagagagaggagggaagatgtaggaaataccctagatagactagtaggtaccaaatccatgaacggccttgtgtaccaagctgaaaaatttagcttttatcctagaagagaaagagaactattatacaacctttactaatacattatgattggcatgttaaaaagtgtagttttaatggatttgcagtgtacaagatgagctgagagacagaaaaactagtgaagaggttttgtagaagatgctatctgaatgaatgagaaaacaaaattgcagtgctaaataagagataagaaatttcaagcttatttgtcttaacaagatcgaaaggattggtaatttatcgtggggcttaatattaaggaataaagaaagtgccagaaaaacttcctgatttttaacatggccagtccattagattgtgtcattcacaaaaatagggaatatagtaagaggaatagattttcagaaaataatgataacatcaattttacatatcctgagttagaaatacctgtggaacatctacgtggtagcttgtcagcaggtgaaaatatgagtttggaattgaagagagaagcctgaactagagataatcattggcatagtttcagtagtcttaatcttagattctctaataaatggaattggtagtaaaattatttgaattaagataatgctatagttcagatgttgtcccctccaaatctcatgttgaaatttgatcctcaatattggaggtggggcttaacgggaagtgtggggtcatgggggtggatccttcttgaatggcttaatgcccttcctgggggcaggttgagtgactgctcattctgttaggttctgcaagagctagttgccaaataacagcctggcacttcccctctctctcttgtttatgctctctaaccatgtgatctctacacaccagctcccctttgcccttcaccatgaatggaagaagcctgaggccctcatgagaagttggtagtggtgccatgcttttttgtacagcctgcagaaccatgagccaaataaaccttccattctttataaattgcccagtctctggcattcctttatagcaacatacatgaacaaagacagatggtaaattttccgttatgtgctgtttgccacaataaaaaatttaaaaaaattgacaataagtacaggataggtgatggccaatcagccaagatgctggccatagagcaatgcagactaggaatgggttaacttccaggtgatattaacactgaagagggctaacagggaaaaaagtaaactaagtagaaatggttggaagtgaccacagagatcactgaaaaaccaaaccaaaccagagaatgtgcaatctcagaaactaacacaatagagaatttaaattgaagagggataggtgatccttgggtaagactatttaaaggcactgagggtgagattacagaaccctagcaaagggcaaaacagttaataaataaaatcttgtccagtagattaatactaattacgtcttaaattaatactcaccatgtgatgcaatttaaaaaacaattatatttaccaagaatgttaggtaaaatgtgcataaaaatagaattacttgacctaatatattaataatttgaactcaagaagcaaactatagtaagaaagacagagtagaaagttttcaagtcaatggattactgaagagtacatgtgacaggcaaataaacactggtagataaatatattaaggaatttggagtggcagattctttctgacatataggatgacaaagaatgtaaaaaatgaaagactggaacaaaaatcagaggagataagggacatataaagtgaaatataaagaaccaggaagatttataggtggtaagaattggaagtgaccaactggtttcaagaaaacaaagaatcttcagtgagaggagctgaagacaggcgtgatgtggcaacctccaaaaaaagacttaaagtgaatttttccgctactgcaatatttttttgttctcaaacaatatttttgcttttcttttataggtggaaatagtgaggatgatagtacactgaaaagacatttcatggttctgacattcaaattgtaaaatatatcgggttgaatgacaaaattacttcatcccccttttaaaatttctatggtacttttgagtctcaaaatcaagggaaaactaatacttttgaagctcatacagtttttgttctagaagttttgtcttttttgtgagcataaatttacccagtgggttcaggaagaagatgagtatttttttttttcaaagcaaacaacgagacagcaggaggttgaaagttctccacatggagttgtcactcaagcactgacatcaaaatcaatgaaaagtggctccagtcttgtgctaagtataatttgtagcagagaggaagttggaggcaaagtgtgaggagaagagagctgagaaaaatagatagtcagatattcagcaaacacaggggaaataaagaggaataaaccctaaagttggcaaaatgatccaaattccaaatggaatgaagtaaaaaaaaaaaaaaaagtggcagcaccatgtagtgcaaacatcactggactgagaatcatttgacaacagacactctgggagtctacttgatctgggcaccattctaggcactgggagtacagtggtaaatgtggcacaggcaatggcctcatggaatttatattgtgatatagaaaagagacaggaaatatacatttaacatcattttagattatatgaaaggcagtaaagcaaaacagagccaggaaaaaagtaagagagtgagagggttgcaagttgggctagggtctatgaaaaactagcccttagctcattatgaaggtttggatgagactttttatccctctaaatttccttagctcccctagctagctttgtctctggaacaagatgacagtttatttcatctttatttccatttctttacatacttcctcttttactgctactactcattctccacttctctttttcactcccctttggtactccttgtttccagaagactctgatccccagctcaagggttccttctctgtactgagtcttgctcgtaattatcttgtgtaacttcaggatttctatattgaacaatacgctgatttctatttctgccttcctcattcattcccaggtaatggggattcaatgaaaatcgacaagaggggatgttggttgtattagtctgttctcatgctgctatgaagaaatacccgagactgggtaatttatgaagaaaacagttttaattgattcaccattctgcatggctggggaggcctcaggaaacttacaatcatggcagaaggcacctcttcacagggtggcaggagggagaatgagtgccagcaggggaaacgccagacacttataaaaccatcagatctcatgtgaaatcacccactatcatgagaatagcatgggggaaactgcctccatgattcaattacctctcactgggtccctcccatgacacctggggattttggagattacaattcaaggtgagatttgggtggggacacagccaaaacatatcattctgctcctggcccctcccaaatctcatgtcatcacatttcaaaacacaataatgccttcccaacagtcacccaaagtcttaactcattccaacattaacccaaaagtccaagtccaaagtttcatctaaggcaaagcaagtcccatccgcctatgagcctgaaaatccaaaacaagttagttacttccaggatacaatggggggtacaggcattgggtaaatacacctgttccgaatgggagaaattggccaaaataaaggggttacaggccacatgcaagtcttaaatccaatagggcagtcattacactttgaactgcccaaatgatctcctttgactacatgtctcacatccaggtcatgctgatgcaagaggtgggctcccatggccttgggcagctctgcccttgtggctttgcagggtacagccccctcccagctgctatcatggctagcactgagtatctgcagcttttctagatgcatggttcaaactatcagcatttctgactattctggggtttggatgatggtggtcctcttctcacagctccactaggcagtgccccagtggggactctgtgtggagctccgaccccacattttccttctgcactgtcccagcagagaggttttccatgagggccctgcccctgcagcaaacttctgcctggacacctaggcttttccatacatcctctgaattctaggcagaggttgcaaacctcaattcttgacttctgtccaaccccaggcccaacaccacatgtaagccactaaggcctgcaccctctgaagcaacagcctgagctgtactttggcttctttgagccacagctggtatgcagggcacgaagtcctgagactccacaaagcagcacggccctgtgcctggcccgtgaaaccatgttttccttttaggcctctgggcttgtgatgggaggggctgccattaagacctctgacatgccctggagacatcttccccattgtcttggcgcttaacatttggctcctttacttaagcaaagttctgcagccagcttgtatttctcagaaaatgggtttttcttttctatcacattgttaggctgcagattttccaaactttgatgctctgcttccctttaaaacaaagttccaatttcagatcatctctctcaagttcaaatttccacagatctctaggccaggggaaaatgctgccagtctctttgctaaagcttagcaacagtgtcctttgctccagttcccaagaagttcctaatctccatctgagaccacctcagcctggacttcatcgtccacatcaccatcggcattttggtcaaaaccattcaacaagtctctaggaagtttcaaattttcccacattttcctgtcatcttctagccctccaaactgttccaacctgtgcctcttacccagttccaagtcacttccacattttcaggtatatttacagcaataccccactctctgcagtaccaatttactgtattagtccgttctcatgctgctatgaagaaatacccaagaccgggtaatttataaagaaaagaggtttaatagactcacagttccgcatggcttcagaggcctccggaaacttacaatcatggaggaaggcaccttttcacagggtgataggagagagaatgagtgccagcaagggaaatgccagatgcttataaaaccatcagatctcatgagaactcattcactatcacgacaacagcatggggggaaacaaacccatgattcaattacttccccctgggtccctcccacaacacatgggaattacagggattacaattcaaggtgagatttgggtggggacacagccaaaccatatcattggtcaaagggcacaaactttcagttataagatgtctggggatctaatgtacattatggttactatagttaataatactttactgtttacttgaaatttgctacaagactggatcttaagtgtcctcatcccccccccccaacacacacacaatagtaactatttcttgtgctagatgtattaattaatttgattgtggtaatcatctcacaatatagtcatataaaatcatcatgttgtataccttgaatacatacagtttttatttctcaattatacttcaataaagctaggtaaggaggaggcagagtatgtcctcaagaagctcacaattgagtagggggaacaacatgaattcaaattgtcccacaaataaatataagatttggtgtgtgctctggaagaggagtataaatagtgccatttacactaacctagtttgggaggtaaggagcgtctttcctgagtataacatttgagctgagacctgaaaagtgagtaggtatgaggtcaaaaattcaaaaggatagtgtctcaatcagagagaccaatatgtgcaatggctttaaaaaacagaaaataagcactttcataagcaaaacaaaactaggagggaggtcaatgtggagataagagagtaagtagttcacagtatctggtataaggatgatgaaatggaaagggtcacactatacaagatcctgtgggatatcatttctttttttgaaatttttattttgagataaatggtaaggtactggagcattttaaacagagttctgtctgtcatcaaatttatattttgaattttcacacagctaagatgcataggagagaagaaatgaatgaggagagattaggtttggatgacagtattatttaacccaataacctgcatagtgttacaagtgaaaggtgggactattagtcactctgaggcaatgacataaagcatgttttctctaggcaaatcaagactatgatcatcctaatataagactactgtaacagtccaggaaagagatgatgagattgtacaggggtatgcaggataaatctaaaaatgaaagctgaaccaagaaatatttaggagcaaaaaaatcaactgaacttagtggtggatgtccagcaggggtgaggtgggaaggttttaagaatgacccccaagattttgttactggatagctaagtggtgctacaaaacctgaagaaaggaatatatcaggggaaggtcatgcatttcatagcagtaaaagatcatgagattatttttgagacatctaagtggaactgttgagtaggcagttaaatatgcagtatggaatacagaggaacttttttcatgccttaaagtcttctcctctttcagttccatttttcttattgttgtctttgggtcccctgaaaacagggcctggatgaggacttgggtacagatagctcatttggaagctgatccctaggaagcaagaatgaaaaaccaaaagagtgagacagagggggaggaaatgccaatcaaatgtattatcatcaaggtaatgcttatggaccatggggactgtattttgacagaacttttgtatgttcctgagaatcacagagaattccccttgcccccggaaggaatagtggttaaaaatatatccatgggctcccatctccattggttgaaggttgctcactcactaaaacttcaagggtgagaaagctcacaaaatctgtgggctcctgggatgtcagagaagtcccttagatagaaagtagaaaaatgggagccattcccttgacatgggatgctgtcagctaaaggcaagtctgaactcacacagggctgtccactgcagctgcaactgcagtgcaggaaaatggcgtgtgactccaggcaccaggggaatctgttacaattgtgatgataatcttttggaagcttttattttcttttacagtgaaatctgtcttatctatagatgattacatagaacgtacacataaagtgtgaagaataattataaagcaacactttatgtaaatacaaccccaatcaagaaatagaatactgctaataccttgaccccacccttgtgttccccacagcacaatcgcctccatctccctggaagtaaccattctcctgaatttttctccttttcttttctttccctccctccctccctccctccctcccttccttcctttctttgtcttcctctctctctttctctgtttctctctctctctctctctctctctttctttttattttttgagacggagtttcactcttgttgcccaggctggagcgcaatggcacaatcttggctcaccgcaacctccacctcctgggttcaagcgattctcctgcctcagcctcccgagtagctgggattacaggcatgcgccaccatgcctggctgattttgtatttttagtagagacacggtttctccatgttggtcaggctggtctcaaactcccgacctcaggtgatccacccacctcggccccccaaagtgttgggattacaggcgtgagccaccgtgcctggcctctccttttactttttacctgctgccttctccagcctagatgtttaggtgttcttaccctcgagacttcagctttgttttatcataacgctggttaactctggcatccatatttttagcctaaacttctctcctgactcatatgctcagttacctcagtggccttgcaaaactagatgtctaaaattgaactcacagttcccctgaaccctaaaatactccatagtttagtaatttctaccacggtctactcggtttatcaagccaaatgcctgggtgttctattcgcgttctctgtatctctccattttatgtccaatcagttaccagggcctgttgtttccacgtgccaagtatcacttgaatctgtctactttgtctccattccctttattacttctttagtttaggtcattattatctatcacctgaaccactggaatagcctccaaagttgctcttatccaatcagttacctattcttcagccagagtaatccctctaaaacccaaatatgctcatgtcactagtctctctacaatgcttcagtggctttcaattacccttcaaataaaatgtgtttgatttctctaacatgtcttaaaatgcagtttgcgaacatgcatgcatttccagcatcatctggaatgtcctccctgacacatcgctcctcacccattcccaaccccaactcagtgcttcagccatactgatatttttaaaacgtgctaggctccattttgcctccaactgttacttgtttctcttgcctggaacactctcccctacttgtttgcctaggtacacctacttatccttcaagtctcatcttcaaatttccttttttttttttttttccagaatttttcctctgacatcgctctgttgcaatactccagactgggtgaggtgattcttcctgattcttccctagtattctacatcctagtatttgtcacgtacagttatttagttttcttactttctaggagtctaggaatcacgcttatcttgatccatattgtatccctagaatctaacacacaggagggcacacagtaatccttaataaattatttgtcagattagtatattgataaattaaggatacaaatgagtaacctacagttaaagaaggaactgcaccagttaagtcaaatagtgtactggaaaatggcttcttatccccctgatggtgacatctcctgctgcctgtaactatataatttaactcttcctaactaattcattatttaaatgatagtcagttgaagtggcattatcatagctcttttctgctaatctatgacgctgctttgggagaccattctacctttgtacaagtatgccatttcaagtttcaaagaaagctgagatgtggtgtataacattttaatctcgagaactatgagcagtaattagatttcccataatatcgaaattattacttctacttaggtatatttaagggtacttcaatatctaaatatatgggacttatagtcatgagaatttagaaaatctaagacctagttatcccctttctttgtattttttgatgctgagataggaaaacgttatccaaagtgagaacaaatgttttaggctcgagtccttttatataactactactcatcattttttcaaatgatagtggaacactcttaagagttgtaccaggtatttcacatctctttattctttccatgagtggctttataaatgtccattctatgctaagtaagtggtattctttgttctgagtaagcattaataacactgctgatgataagaaatattttttcccctggaggaagccttaagaagattagggaaacacattaaacaatctatattccctttattagctacaaggaatctattgactagtatttatctaaaacaggggtcagtgaactacggcttgtgggccaaatccaaccaactgcctgttcttgcaaacacacttttattggaacacagccacacttatgcatttacaaactgcctatggctgctttgcacctcattagcagagttgagtaacttcaacaaagatcttctggcttgtaaaacccaaaatatttactatctggctttttacagaaaaaattggcaaaacttcgaccaaaaccttcttgaagtgacttacattactaacctatacctcccgctgaaacagtaaattatataaaccaataattgactttataaatatggattttttatttgcctcaaatcgtgtcttccaagattcaaatggcatcccctaattgcaatgtattatgatttggtgaataaattcttgttctcactactgtagttagaagaaaaatggactaggaatacgaagagaaaagattctgtcctgattctcctcttattcagtttcctcaactgcgggaatttataatcttcattcttaagggaaattttagataatatatacatgtaaacaattttattattttttgatcagatggatttcaatattttgttttcttcactctagggttcactaactacagtcataacttgtttcagttgatattcatgtgacagtctgatcaaatgtatcatttgttcagttattctgctacctccaatttattccttgagtgtgcatcccttggtatggcttattgctgacctcattatttctgcccacgcaggtctatccactcattcatctcaatccacttgcatccatggccttgctcacactgggttttactataatgcttcagatttatccagatgagaaaaataaattccagccaagaagcatgcttaagtgggacactggctagaggaaaggtcaacaatatccattatgataagtggtaacacctctgttaactccctttttattttacagaaattttattatcatctagtccagtgacttttagtatttttaaagcatacaacccttttttcaagtgagctcctaagaagaaatccggtatgtgaagcctaaaaagggcgagagcaacagactggttgaaattgcagatgggaggcaaagggaagtatgaacatatgttggaggaaactctacccttttgacggccgaaggggacgctttccagaagaggtgatgaactctatgtttctggtttgtgtgattgattgaagttccagcccatattcatttctacgatttcatgctgtaggcaattgggtccacttattcaccacagccaccgaacaaagaaaacactagaaaatactttcagagaatcaggtctgaacacaaaaaagaattttccaagggagtcgtggtgcccttaagattaaatgaagtgctgtttaaacatatttatttaattgattttgacttgcagcagggtgctggactatggtaccctatagattttccagatctactttttgtaattctgctgctgtactggctttttgaccttgaattgacagttacagatgtgggagaataaataaagctaagtagtaacactgtgggagaatcaagcctatcatcttaatgtctttttctctcctgattgccttctattctagaggagccaaaaaaagaaaagaaaagaaaagaaaagaacgtatatatttcttcatattgaaaccacttccgtaactctgaggttatagtattaagcttcaaaggtactactacttaaggcccaattccacccacggagatttaataaaagatttagatgtcatgcaaaacggaaaagaaaggggaagagagagtattgttgtttaatttcatttggaaaatatgtacaaaagcatgcacaatatggtagaattggtcctagagtatatggagtcttcattcatagactgcatgaccaagattcagtatgtttaacataaaggtaaaagacaggcatgaactttataaagactcaggttcaaggccatgctgtgcccacttagtagctgggtgtttttggataaccattctctctaggctttcatttcctctcatggtgaaaaataataataatgtagtacctatttcataaggctgctgtaagattaaacagaaaaatgcacaaagaatacttggcaaaatgcctggtacagagcaaggcattaatgcgtgttagccctaagataaatattaggtatgttcgggtcaatgcaaaagctagggggaataatcgaaatgaaagcaggtattatttttgaaaatggctatgataggcctatatattactggaatagaaccaaactgtgagaccttagagaccctccaggagagttaaacatgaagtgacaatgttgttttgcctgatttacatcagacttatgttgttaaagcaccccttttttcaatatgaagcatttattcacccagataatggatacaaatccatgcattcaaatgttccttggagtcagagatcaagatggaaatccccagaatcatagagatttgcgtctgtaaactggcttattatattcacattcaaagaggttggaaggggcagtgtcagctttttaactagaatcttttcattacttctccctgttggggttgcaacacatgctgtgagtgacctccagagattcctcaagctgtatgcaggcagcaaattgaatctgaaagctttattagacaagtttttcttgtctttcagctggtgggagtggatgtcagttgtattggaaaaaataaaacttcttgtgaaactgggtcctgaccttgaaaaaaaagctcaaatcgaagtgtacaattcaatcctgagttatgtgcttatttgttaaacagtgtgcaggttcaaaggaaaagggcatattttaccttaaagaaataagaatcaacaataaaaataataggagttctgttttgatcatgctgaacttagtaagcaaaagtgcctatcaccaaatcacatagttatgaaaagtatgctaataatcgaagaaacaattcccattcacttcagtatgacaagaaaactattataatccataatgaacattatagaacatttatttatattgtgtattcatacatttctttgagaataaagaagagtcctgggaaaatgaagggacattggagattggctagtttgttttatttcaatattgtctctcatatatacatataaaatctcttatatatatatgagtttatatataaatatatatgagtttatatataaatatatatgagtttatatatatatgagtttatatataaatatatatgagtttatatatatagtttcctatataaaaactatatagagatatagctatctgtatatataaccatatatagtgacatgtaatatatatataaactatatacagttatatgtctatatagctatatatatatagtgatgtaatttagttcctggtttttaatattggagaacaattatgagtttttttgaaggtgtgataattattccagaagtaggaattgaaagtagtataattttgactttttttttcctattgtaggtttatattgcaatttaagtgggtactggtatagttagtgctgctagcaattttacctaaatattaggatacctagattgtttgtctaatgaactcagcatgggctggcaagcactttggaaataagagtaaaacatattttcataaaaatactgaagatgagagaaggaataaaccttatgaattttaagaggaaggtagcatgtaaagcagaggttctcaaatttgatttcaagacacagtcaagaatgagggtttaaggagataggggttatatctggcctggaagatttgcatcaatgccatagaatatccctctttgatcagcactgtaatcttaaaaaaatagggcttactactgagattgtgaagatatatatatatatctgtcagctgtgtctcagcagggaacaaagttgagatatataagaatgctgaagagcactgaaattaaactcaggagatgtggggttgggtccagattctgccactaaacagctggtcaagcacgcgatcatttaatcttcttggtattattattattacatgggaaggttgatgtatttgatctatctgtaaaatatatgttcacttgaccaaaaaatattagtgcaatacctaccatatgctagtcattgaattaaagctagacacacctggtatttggcatgtaaacgtaggaaaagggtatatatagactttatgatgtgacagagtcatgggaagaccagtaattatggaacagcatccaattctgaagcccacaacagaaaaatagtatggaaaacacttggaagggtaggaggagggccacagagacgttaaaaatttgagaaacagctgttttgttgccagaccatggggactcatctgatttaagatagaaaagaaaagtgggaaggagattaaataacagacctcaaagaatgaacactgtcgaaatgtacagtaagcataaatgtatttttcctattcgaataaaaataatttagacagtaactggaacttaggttaggtagttgaaaaactgtcaagtatagcagattggtagaactccatctgctcttcactttttaagaagagagttggcagttacgcttctaagattgcttctaatagaatgagagcctttcctgagatagtggaaaagaaagaatgactgttcaaatacttttcagaccacaatcttaaaatcgacaattgaagtacaaaactgctacaatttcctttcgaaatcttgtttctctctgaaggtaaagttatattcaattttaaaactattcagtgaagttttaggaaatattaggaatacatgttgaagccttccattttgagcggtagggtacttactctcataaatatgcctaaatagttctggtttcttggtcagagtatgacagtcaagattatggtatactctgtagtgatttcaagcaaaagtcctttcttgaagagtgttaaatagcataagaaggttaaagtaagtttactgtaattaacattttatttctgttaaaatgcaggacataggtaatcaaaaaatctctaatcatcagaattgatgttagccttctctttttcctagaaatgatgaactagagtttctcttccttcatcagttcagaccccaaagcacaaccctaactggaaatggtaaccatgcaataaaactaccaaaaggttaagagagggagaagaaagggaacttcatcacaaaatggataattaacatctaaatgctgaatactaaatactaaacagtagaagtttcacattctatcactgtcttggatgttaacaatgatgccactgtagtgcctttcctgttaaccagtgagcattgttgaaggacctggcctgggaccagggaccccctactgccttcatggaaagacttccttctgatgagtgtgagaagtgctggggcctcaccagccagggctttctgttgtcactcccctttctacagtgtgacacatctcattatatttcaagcactcttacctcactgatacatacaaatatgaatttttaaattaattaattaatgtcaagagttaaggagtctctccagctgctccaaggccttgcagtatcttgggatagggtttaaaatggatttattttgttattggaactgattaagggtcttcacattttttgtacaaaagcttgctcctgacgtattagactttgaggaagttttcaaggtttagagcctgtaactataaaaccggcaatagtatagccatgtcgtaagtgtttttagcagagaaatcatctgttaatgaggaagaaaaagatttggcctcacggaaatttatttgcctaatcctaaaggttcacctgaagcagaatcaacagtggaaacataaccacaacaggaaagggtgtgggttatatacccctcccctgccatgtttctattaatgagaaggatcaggacccaagagaggaataagaatgcaagaactaattgccatcctctttttcctttgctgcagataaacgaaggccattttcacaaaaaaaatgatcactgcagataaatgtagggtattgtcacaataaattaaccattttttttttttgcaatttaagccaacaaaagtagtatgacaagagtacatttaagtgccaagtaacctcatgctttaactgcctagatatttaaagtattattgaaatggaaatggaatgctttatttaactttgtagaggtgagtgaagttcaaattaaaatgtataaatcaccatggaatactatgcagccataaaaaatgatgagttcatgtcctttgtagggatatggatgaagctgtaaaccatcattctcagcaaactatcgcaaggacaaaaaaccaaacaccgcatattctcactcacaggtgggaattgaacaatgagaacacatggtcacaggaaggggaacatcacacactggggcctgctgtggggtggggggaggggggagggatagcattaggagatatacctaatgttcaatgacgagttaatgggtgcagcacaccaacatggcacatgtatatatatgtaacagacctgcacattgtgcacatgtaccctaaaacttaaagtataataaaaaaaagttaagcaaaaataaataaataaataaaacaaataaaaaggtataaataaccttatatgtgaggatttgatattcaatttaaatagagacttcaaaaaattcaaatgaagataactaaatcactgcttgatacatggtgcactgattaatagcataagctctggaatcatagagacttatttttgaatacccactctgtcactgactagctctgtaaccttggacaaattatttaacctttctgacccttggttatctcatctataaaatgggaattgcaacataacttactcaaaaggtataactgtggcactaattctaagacttgtattaatttaggtttgctcagaagtagaccctgagacaaggatttaaatacaaataattcaattgggagctgatcccagaaagccatggtagaagagaagatagagctgcagagctgaagatacatatatatctgtcagttgtatctcagcagggaacaaagttgagatatatgagaatactgaagaggactgaaatcaaactcaggagatgtggggttgggtccagattctgccaaaatgggaagaaagcctacacatcggaaggaagcctatacgaggcatgctaataagtatgcttatcattgtggtcaactgcccaattcactggagatttttagtgtggaacatgcattggaggtgtcctacccaaggggagaagaaggtgggatatttattgatatggtttggctgtgttctcacccaaatctcatcttgaattgtaactccaataatccccacgtgttgtgggagggaccatgtgggaggtaactgaatcatgggggtggggttttcctgtgctgttctcctgatagtgaataagtctcatgagatctgatggttttataaagagcagtttccctgcacatgctctcttgcctgctgtcatgtaagaagtgcctctgctcttccttcgccttctgccatgattgtgaggcctctccagccatgtggaactgtgagtccattaaacttctttttcctgtataaattatccagtctcgggtatttcttcatagcagtatgaaaactatgaagaccaacacctttatcccccagcttttgtccattggttaagtgctattccagagataatctcctccccagcttccagcctgctctgcaagtgggagagctactcctacaggcagagaaaggactcaggaagactcacaggtacttgtagttagacgcttcatggtttataggaaggctgagtgctaaggggaaatgggtagcccactaagggtcaaatctatcttacctgcctcgtttctgtaaataaagtgtcactggagcacagccatgtccctttatttaggtattgtctgtggcttttagtatacaatgacagagttgaccacatgacccataaagcagaaaatatctagtatcggtcctttgcagaaacagtctgttgatcccttatatagttggtagcacaactgagatatcagaatttaggcttcttgacctccaatactgtgctttcctaattacacttgagacttgctctctccaaacttaattacaggaagagatgattttaccagtgtttaatcaactagaaaactctgggccgggcgcggtggctcacgcctgtaatcccagcactttggaaggccgaggcgggcggatcacgaggtcaggagatcgagaccatcctggctaacacagtgaaaccccgtctctactaaaaaacacaaaaaaattagccgggcgtggtggcgggcgcctgtagtcccagctacgggggaggctgaggcaggagaatggcgtgaacccgggaggcggagcttgcagtgagccgagatcgcgccactgcactccagcctgggcgacagagtgagactccgtctcaaaaaaaaaaaaaaaaaaaaaaaaaaaaaaaaagaaaactctgttaactggctcttctatatgtccatatacaatgggttattcattccatagttattaccaagagacatttgaatcaaatatcctgatttggagtcttcacattaagcatgtctatatgcaatttctttcaaaaatgctaaatcgggtattgtagaacattaatgttctcaggcccagcagcttgtggataagaaaggattcacattgacatttacaaccagatttgctggctctttgcctccatctgccatgcaagccttcagacccatgcaaagtcctgtctacctaaatgattgtgaaagtctctagaggaacttatggcttttcttctcagaggtctcatccaggaacactgaacagctctgcagggcaaatactgcctggtttagtgtgttgtccatctccttgaacttctaagctataacatcctcggggtggggagatggggagtagaggtgctaaaataagatggatttccctttagcattcacagcactggatctcattggaatcccactccttgctgcacacagcagaagggatgaatttattcttccccactcactgtatgtctgtggtagtagttctcaaagcataggccagcatcagcataacctaggaacttttcagagatgcaagtcttggctgggcacagtggctcacgcctgtaatcccagcactatgggaggctgaggcaggtggatcacctgaggtcaggagttcgagaccagcctgaccaacatggtgaaaccctgtctctactaaaaatacaaaaattagccaggcgtggtggcgggtgcctataatcctagctactcaggaggctgaggcaggagaaccgcttcaacccaggaggcagaggttgctgtgagccgagattgcaccactgcactccagcctgggtgacagagcaagactcagtctcaaaaaaaaagagagagagagagatgcaggtctcaccccagagctagtaaatcagaaactctggggttgaagcccagtaatctatactttgcgaagaactgggtggttctaacgcatggtaatttttgagaattaagttggattaagaccaacacttttgatctccagtttccctccttttccccaatgtagtgatttgtgtataaatacggtgacaataaaaccttctatccccaatatgcatacccctttgatatgcgatgtggcatctcctcctttcacgagatgaagtaatttcctcatctcttgaatctgggctgatcttttgaggtgctttgaccaatataacttagcagaagtaacctacacgtttcaaagcctaggcatcagaaggtcttgtagcttccacccgccctctcttggaaaactgccctgagaataccatgtaatgaagcctaatctagcctacaggatgatgagtggccttatgaagaatcaaggttctgcaaccaacagccagctgtcagatatctgagagagtgcattttagaccatctagctcctgttcacttgctagataactgcatccacataagtaacaccaagcaagaccatcagaataactatccagctaatcacagagcaaacttcagacacacagaattatgagcaataaatcactcgttttgaactgttaagttttggggtgcttctatgcaacaatagaaactgatatggacaggtgtctaagcaacaacaattgcaagttttgctttttttttccagtatgttgatttgtcctgataattaaaacaatttatacagctcaggcaaggccaccccattataatttataatttaagtaagcagccacaaggtagtttggtttagtgttcataaaacaaaacaagcaactttaggcctcagcttctacatctataaaagaagaatactcaactagataataattgcaataattattccaagtttggatttctatggttctaagaaattcaaatagagtgaaccaattttttctacttcttaagtagaaaaaacacagaaacaggccagtcaaggtggctcatgcctgtaatcccagcactttgagaggctgaggcaggcggatcacttgaggtcaggagtttaagaccagcctgatcaacatggagcaaccccgtctttactaaaactacaaaaattagctgggcatggtggtgcgcacctgtatcccagctacttgggaggctgaggcaggagaatcgcttgaacctgaaaggcagaggttgtagtaaaccgagatcgcaccactgcactccagcctgggcaacagagcaagattctgtcacacacacacacacacacacacacacaaagaaaaaagaaagaaagaaaagaaaaaacacggaaacttgtatcacttttactccagataaatttaagattgagttaaattatattaactgctggccagctgcatctgtatctgtaattttccattaggttcttggacagagagatagtgtaaagcacagccacaaaacaaaacacaggctgtggagcttgacatgtggactgaaacccttgcttgcttgctttctagctgtgtggccttaatctagctatctcccctctaaacctcaggctccttaatctttaaaaattatctatatgttctttgcagttattttgaggataaagacatatatgttaaagctacaagtatatgtgtagcttctacatatttaatagtaggaatgcaatggaaacaatctgctataatgaattataaattctattacattgtaatacagtacatgaaataataaacatatacaagaagcataatacaaattagattttctttttttatattgcatttatttctgattaacttcctgcaagtcaggaagtcgggaatagaaacaattctttattctgatatttgaactaccacagtaaagaaaaaagaaaatcttattttaataaaagcagctctgaatttaaatgactaccttttgttttttttttcattcaacatttgtgtatttaacatcttgacttaatgctcagatctgtttcggtttgctaaagaggatgaaaagcacctgcttttgagaaaattcctctttcccttaattcttttttagctactaccacaactctgccagctatcaccaaacagctttgagctgagggcattcccagactctccatactggcagcaatgtggaggacataggagaagacaagagtggtggggggtgatgagaccctcatgttggggagaaggaagtagggcagtgctatgaaagatgagtatctctcatggcttccatcacacttcccctgacccactcctctagtctcactgatctccttaatattccgtcatcttgttcctacttcagtatcgttgctcagtcttttctctccctgcctggaataattttcccagaaatacaccaggctcacttcctcacttacatcagttttctgatgttctcttaacagacaagcttccctgaccacactatagacaataataccctcatcccatctccctgcttagttgttctctgtaatggtgtttctcaaatgtcagtgtgcacaggattcacctggggattctattaaaatgcagattgtgattcagtgggtctaggataggggcctcagattctgtgtgtctaacaaatacccattgacatcaatctgtagactacactctacagcacttataattattgagacagtatatattttcttcattagtttattgtctttctctttcaattacaatatatgttttatgaaaggagagacttttattctatgctgtactcgcagcaccagtatgatgctcaacacatggaagttaataaataaagtggatgaattatatatgttgctggaagtcaaaactggaacttccaatgtatttttcttataaacattgttacatttaggtaagttacacgttaaatggatttcggcgccctggttttggagccttcctaccatgtgtaacgtggcttatatgggacataaactcatgagttcagagtttaacaaacttataaaacatcattggaacataatctcttcatggagttacagagtctgaggctgaacctaccagagacagccagaaaacagacaccaataaatgataacataggaacaaactatgcatatgcgctgagggaaccaaaaattacagctcataaaaacaaataaacctgacacagttgagtataaccctgatacagcaatttcagtgtcccagattgacaaaaaaaaaaaaccataatgcttaagtctccaaagtcgttaaatctaactctgatgactgccgagtaatcccagagggcacatgagatgcactgtccccagattgtagggcttcttttaatccaagcactatttatgccttctaatgaattatgattgtgctaccccagctgtgattcttccagttcagtatttttctacttgacataaaataaaaatcaactttacctgaagaaccagtcaccatgctttaatgcttcaatcatttgatctttgaaaagcagacaaggcaaaaaaaaaaacaaaaacaaaaaacaacacccaaagatgtttttagttctgcctaattatggaatggtacagcaaagaagttttctggcctctttcccctgagagtcaaagccagcattaacattgccatgagaatttatgaataccttctatcaacaactgaagaggaaagaaaataaaatagactgaaaatatgcagtgaaaacaaaagttaaaactacagctaaatgaggaaatattcctcccccaagtcagcttgtggtcctcccaatccatttttctttttcttgaactaaaaatgggagagctcttaaattgtttgcaaatgggacagggagaggtgctagtaggactgtgtgtgtttctgtggtttctgtgatttttgtagacatacttgtccctcttcaggaacaatgcacacatccctggatgctaggaatattggttgttaatggtgttccttactaagaattgccttcggcctcagaaaacttgtccaagttgtccttccactctcaggcagcagccagcccctggccaatggctggctggatcaggaatacaagggccaggcccactgcctgcaattcaggacagctctgcacagccagcccagatgtagggctcctgcgagactggcttaggcctctgctgcagacaaatcacatttcagactctcccacaatctcccttgtgctcttctcttccttgtgggtgtatctccagagaacactccccatatcccgttgtcatgcaacactttgaatcagagtcaatttccaaggaatgtactctaagactttttgcacagtcaataacacaaaggtttatctctatctttagaattgaaacaaattttctctctcacccagtcatcacttcatagttgcacttttgaacaaatagctagagccaaagagaatgggatccagtatacttacaggctccaatagtggtcagtccaggagctaggtcaggctgctttgccctcagctcttgaagtaaacggtttaccgccttccactcagagctcagatcttctaacttcctctttaacagaaaagcatacacattacttattcgattaacactttgaagataattcatgaacatcttaatccatttggtgaatatattattggatttctattatattttacttctaaattaactttagtgggtagaatttcttttaaaggaattataattattttagccaaccaccctacaaatatttatcaattgctccatacaaaaaccctttctccaggcataattttatttaaaggaagtagagtgcaaacattagtgaaaacaaaccaacaaaaaacagttccctctcagcaactagcttaattcttgaagagtatctattgtggttgcatactaaaattatccagataactttaggaaaatcctaatgtactggctcacccccagtcaattatatcagagtctcttaaagggaggggctgcagtggacacgggaatatgctactcagagcccccttcaaagaaagactcttgttctagatgatggaaatgatgtcagtagacattcttcaactgtcagtcccttcagggactgcctgagctgcagagagctgccttgtccaagttcatgcctttccccaggcagccctcattcagtgactgatgaaggtgaaagtatagaggcctaatttggctcaaagcaggacaagtttgaagggctacttcagctgcagagctccccgtggcataaggcaagcctgtatatggccagtggtgtgctggtagatgtatatcaactggatctctgatctcagggtgtttaaaaacaccttgtttttagtgtttgccaatttctgtggtgtaaatattcctaccacggttaaatttaaattaccaagaagataacatcaagtggctcaaaaaatgcctggcaatataacagtaggccgtcctgagctggttccacttcactgggcagctagctatacgataatttatagccagcagaatgtgagcagaagtgttgtttgtcagtttggggctgaggctttgaaaaatttagtgaggtttccacattttttttcctttctattgctggaagcagaagactcttaggtcctacggcaaatctttacaacttactgaggagagaattaagtcctaacgccctagggcagttgttctcatactttaggatcaacagaatcacctggagaccttgctaattgctgcatggtagccccggagttctggatttagtagatactgggtggagcccaataatttgcatttttaacaattttccaggtggtgttgatgctgattgttcatgacaaaatcctaagatatctattacacctaatcagttacctgagcatttatcatagactagatatgtaccattcttgagaacataatagaccctcagatcattttcaataggatttcatcctcttgcgaaacccgagcagagaaaagctaccaagggaatggcaggcagaggaagaagatgaacaggacctaggtttctgcaataacatatgtaagaaagctgcttgactaggaaaacatacgctgggttgtcatgtgagcaagaaaagaactcctattgtgttaagccactgaaatatttagttcattacaagcagcaataccttaccagtatagtagcactagtcacaaaagctttaccagtgcctataagagataatagctgcgtttttgtatcactgtaaattcctatgcttaccttatgaggaatacaaataacttgattgatgtcgggtttggttaaaataaatacattagcagaaattgcatttctagtctgaagaatcagagttggaaaagagccagaaactacaaactctttaaataggaatggaatgaacccaacctaactggaatgtttcatatacacgttgtagtttaatgctaatcattaatttaatgcgaatcatttcaatgaaaccattactttatttattccagaaaaataattgttcaggtgctactctgtgccagactttgtgccagttactaagcttacaaaactgaagttcgtaacctctaagcattcacagacatgtaagtaaattagaacagagattttaggaaaaaataatgatttcaacaagacacctcgggggaacagcttaactcagcctggagaggtcaataggttacccacaaaagctaacatttgaatttattttgaaagacgactaggaagttttcagaaggggccattcaagcgccaggtggaaaaagggcatttcagacagaaggaaaactacgtgcaaaatggcaagaggtatcgagccttaaaaaagaaatgcagtgtgtcctggctatctagactacagtgtttacaagtaatgatacagagctgcaagaatgcaatttattaagaccttgtaatgtgggactattacattctcttctaaaaccacagagtagatggaagtgtttagagaagaagagccatatgatacgattcgtgttttgcattgtggaggctttatcagaagggtgcagagatacaagttgggaggctaacatggtaactggagtgggaagtggtcagctggactgaaggctttggccatacagaaaaaggcagaggggtgtgtgtgtgtgtgtgtgtgtgtgtgtgtgtgtgtgtgtgtgtgtgtatttttcttgcctttgatagttgagattttgagctggtaaacgacgaagagaaacttgccatcaaattgtttcttccagttgtgggatatgatgaggtttctcttcaaataatctgatcaatcttttattctttaattcatagtaccccctgatttttctcctttttcctttttacctttgttagatgcccaggcacacctcagtaccagctcacattcatttccttatttggaaagaggactaactttctagctcattacagacgccccttccccttcctctccacttgattttacgtgcccaccctatctaaaaaaatcaaatgtttagccaactgggattagtttagattgtacgacccaaccccagccaatggggggaaagggtacaggggcaggacttgcgtcaggaataaaggctctcatgcccctttgttcaggtgtgctctcatggcaactggccaaggaggcacccctctgtgcagaagtaaaattgctttgctaagaatcctttgttcgagtgttcaatgtcctcaggattttgagcattattcctaacacagtctaccctgtcagcatgtgtctttccagtcagactatgtgcccttcgcaaggcaggactgagtcctctatgccttgtacgatgttttctttatatccagtctagtgcttcctaataagaggagttcagtaaatatttctgaattgaataaaattaaatgaaaattgctacttgaataaaggaaaagagaaagagataaataagtttcttttcccccaacttgacttcaatgtgaactacataccatggatgactttatatatatatgggacttgaaggagcctatgtaggttttccaggcgtgcaatcattttattaggcttattttttcttttgagacagggtctcactctgtcacccaggcgggagagcagtggcaagatctcggctcactgcagcctcgacttcctaggcaatcctcccacctcagcctcctgagtagctactcagtactactactgagtagtactactgagtacatacatttttatgtagagacggggttttgccatgttgcccaggctggtctcaaactcctggactccagtgatctgcccatcccagcctcccaaagcgctggaattacaggtgtgagccaccacacccagccttattaggcttttataaatcctgaaccaaactgtatttaaaaagtaatctcatagactagggtcacaaattcaggtccctatagggactaggttgtaacaaagggaagaataagccttgtctaaatcagagagctataacttcagatgtggctgctgactgccaacagaaaggtgggcataagttaaaaagcaaaacacagaaaaacaaacaaaaaaccctgctgatcatattccctcaccagtgtataccggagaagtttctctcacattcttaaggtcataaggaagtacaagaaagtttgttgctgcattgtggggaattgaggccaacatgggtatgtatgtgaaagaaatggataagggtatatgtagagcaatgtggatggatttttttcttttttttttttagatggagtttcactgttgttgccctggctggaatgcagtggtgagatcttggctcactgcaacctttgcctcctgggttcaagtgattctcctgcctcagcctcccggtagctgggattacaggctcgcaccaccacacccgggtaatttttgtattttgtatttcaccatgttggccaggctgccttgaactcctgacctcagatgatctgcccatcttggcctcccaatgtgctgggattgcaggcatgagccactgcgcccggccatgggtggatctttaaaacacaattatgaatgttagaaaagctaagaaacaagatttatagcacaatgtagcttttataaatttaaaatatacttataaataatatattttaaaaggataaagcaggaaagaaacaggaatagagatattattgtcacatttcagtaattttgctaatcggttattaaacataaccattaatataaattaaattttataaatataaaataaactgtgctaagaacaaaagataatatatagtaagaattcatcacttcctaatttaactatcatcagtgctcttgagactatgtctattgtgtctgacatcaagtcaaatcaaggctttcaatgtttttatccagaatgcatgatgtaaatatttactagcatatcaataaatgtaacttttttatttattaaaaatcagtcttgaacccaaaagcaaacaaaaaataatgcctctgattagtcaggaaaaccacccttggaagtcatcactcacggaagatattttcctgtcctgacatcagaacctaaacactaaaaattaaatattctaagagactagtgagtaatatatttgatcttctggtttccctgtgaagtttctgtaaccctacaaagacagaatactaaaagcaatgagaagtaatcattctgataacagaaagtagcaataggagacaatgaacatgaaaaacttaaaactgagaaatgtggtaatcttagtcatttatcaatgaaatgacctttcaacatgggatgaaatctcatcctacaccatttaatttataggaaatcacctatatgtgctgagatagagagaaaaggagagatagtgatagattagggattgatttaaatactgctgggggtatgcccatctttccactcagtaagcatattgcccctcagaatgaggataaagagagatcaaagtttgctgtttctatgtttctaccagttgacttaggttccactctcttctcatggtgtaagtatctcagtgatttgagttagctttaatacttaaaggtatgtatttatcttacagtctagcttctaaaagcaaattaaccacttcaactgggtctcaactgaagaaagggtgctttgaatttcatgttcctcatataacactgtatcactaaacagagcaaaaattgatgtgataacgacacccctgaaaattaagaaaagttaatttacattgtgatttagaatcagaagtcttaggtttcgttcctaattcactactactggttgtgtgatccttggaaaatgagatgggtcactaagatttatcatccttgaaacatggatataataataccacctaactcatagctttgttggagaaactaaacgagatattttatatggtaaaaatgctgtgaactacaaagcactataaatttgttggttagatattatgcgctgctcaatgaagcaaaacagaagatattcaagaaaagttctcattaaaatagttacgataaaatttttttcagtgctttattaaaggactaggttttagttacctagaaaataacatgtttgtacatgcaatttctcttttattaatacataaactctaaatagtctgtccatttactctaatattatctttcccactcttatttccagataggtaaatgaggggttactataatctctaatgtagaggtggatttttaaaattaaatggcactaccaatgtatcacaaatgtctgaggacactgcaatgggtcaaaggttcaataagctcagaactgtataatttccaatcttttataattattagcaaatacttatgaaatgactacagtttttgatttggctgttcacaaaaacaatcttgctactttttcaagagtttggtgtactgtagagttgaaatggattatttatatattatacaagttcttttttgttttgcttcattttgcttttcacttctctggcatttgcccatattttcaattctctcatcattccaattaagctgtaaaattcatttgcataacaaaaaatgtttggctgtagcaactagtcaggtgttcatcatataataaaatttaagcagtgctcaatagaaatctgtaaaaggtaacaatttgcaatacatgttaatcatctataagcaaatttaaggaaatcaaataagtacttaaatcccaacttatttaaatagcgtatcagtgggataatagttatcaagtcctattcttgactacatctccataattttaaaactttgaatatgctaactaaattgcaggtccaaggttttccgcacaagagctccaaactcaacagagtgaattcgtgttctaccaaaatggataaactttgggaattcttttgtttgtaaatggaaaaatcagatttattataggtgacttttgcagctgagcattattctccattgtatatactttgcttgaaaatattcattaaatgttaagacaactatatcaaactatgaaatttctgctttatgaagaacaggaattagttacaagaaaaagtgatttctgaatatagctttccttttaaaatttaaaatggataaatatttaaggtgatagatactgcaatcactctgatttgatcattatatattatatgcttgtatcaaaatatcacttgtggtaaaaggacggaaaaagatactccatgcaaatgggaaccaaaagcaagcaggagtagctattcttatatcagacaaaatgggctttaaagcaataaccgtaaataaaagataaagaaagacattgtataatgataaaaggattagtccaacaagaagatatttactacagtactcaatttatatgcacctaacactggtgctcctagctttataaaacaatagtactagacctaagaaatgagatagacagcaatgcaataatagtgggggacttcaatactccatttacagcactagacaggtcactgaaacaaaaacttaacaaagaaacaatggacttaaattacaccctagaacaaatggacttaacagatatttacagaacattcttcctaacaattatagaatatacattcttatcagcagatggaccattctccaagacaggtcatacaagagaccacaaagtcttaataaatttaggaaaatcaaaatcatatcaagtatcttctcagaccacagtggaataaaactaaaaatcaactccaaaaggaaccctcaaaactatacaaacacatggaaattaagaaatctgctcttgaatgattttggggttaacaatgaaattgagatggaaattaaaatattttttgaaatgattaatagtgacacaatttatcaaaacctctgagatacagcaaaaacagtgctaagaggaaagttcatagtgttaaatactacatcaaaaattctgaaagagcacaaattgacaacctaatgtcacatttcaaggaactagagaaacaagaacaaactaaactcaaatccagcagaagaaaagaaataacaaagatcaaagcagaactaaatgaagttgaaacaaaaaaatacaaaatataaatgaaacaaatagttctttgaaaagataaacaaaattgatagaccattagcaagattaaccaaggaaagaagagagaagattcaaataagctcaagtagaaatgaaactggaaacactacaacctacatcacaaaaatacaaaagatcattcactactactatgaacacctttatgcacacaaactagaaaatctagaggaaatggatacattcctggaaacacacaaccctcctagtttaaatcaagaagaaatagaaaccctgaacgctttggctgggcgcggtggctcacgtctgtgattttagcactttgggaggctgaggcaggtggatcactaggtcaggagttcgagacctgcctggccaacacagtgaaactccgactctactaaaaatacaaaaattagctgggcgtggtggtgggcacctgtaatctcagctacttgggaggctgaggcaggagaattacttgaaactggaaggtggaggttgcagtgagccaagatcatgccacagcactaaagcctaggtgaaagagcaaaactccatctcaaaaaaaaaaaaaaaaaagaaagaaaccctgaacataccagtaacgagcagcaaggttgaatatcagtaatttaaaaattgccaaaaaaaagtccaggaccagatggattcacagctgaattctaccagacattcaaagaagaattggtaccaattataatgaaactatttcaaaagataaagagggaatcctccctaaatcattctatgaagtcagtatcaccctaataccaaaaccagaaaaggaaataacaaaaaagaaagcagcagcacaaaaatagcagcacaatttgcaattgcaagatatggaaccaacccaagtgtccatcgaccaatgaatggataaagaaaatgtggtatctatataccatggaatattactcagccataaaaaagaatctcttttgcagcaacttgaatggagctggcagccactattccaagtaaagtaactcaggaacggaaaactaaataccatatgttctcactcgtaagtgggagctaagctatgaggatacaaagacatacggagtgatacaatggactttggggactctaagtggggagcttgggagtgaggtaagggataaaagactatttattgggtacagtatatagtactcaggaaatggatacataaaaaatttcagaattcgccactatagaactcatccatgtaaccaaaaaccacctatacccccaaaactactgaaattataaaaaataagcaaaatataacttgtaccgcacaaataaatatgtacaattatacacatataaaattaaaaataaaaaaaaattttttaattaagtttcctaaggtagctacaattgtggctgctttcttgcctcatattttttggatatttaaaaaatattaaatgatttttatgttttctatcattaagacaaggaaaaaagccttctagaaatagatattatttgatgtagaataagtaaggaaaaataatgtatttgtttaatacaatcataaaaaatcatttgtttaaaaaagtaaactagaatatagttttaaactctatttgagtttgagattttcaaaatttaaaaatatatcttgtgtcaatggttggcatgcaattaatatctactgaataaataaaggactctacctacggctgtatatatacaggcatacattcgaatattgtaactgaaacatctatgtctctttgtctctctctttaagtgtaactaatacaactgaggacaagaggtgaaattcaaatctctaaaatgcttccctaatttcagcatgagctactgagtacatgagacttttcactcaaatattctctcagaaaagaaagttggctcatattcaagactttatactatctcttatgtctcaattattttattcggaaccacaatgttgtatattagcctgaaataacctcaagagatgtgatgcttacataagtattctgacagaatttgcttaattaaaaagggaggcaaagaaagttgataaatctttagcaatcattcctaatgtatagcttcacaatcactcgtggcagagatcattgtaaacgagtctttcaaagaatttgttaaaaagccaaacaacttaaaaagcagaaagaatatgttagtctattgggaatttttaaaagatcacatctggctgggtgcagtggctcacgcctgtaatcccaggactttgggaggccgaggcagcctgatcacctgaggtcgggagttcgagaccagcttgaccaacgtggagaaaccccatctctactaaaaatacaaaattagctgggcatggtggtgggcgcctgtaatcccagctacttggaaggctgaggcaggagaatcgcttgaacctgggaggtgtaggttgcggtgagccgagatcgcgccaccgcactccagcctgggcaacaagagcgaaactccgtctcaaaaacaaacaaacaaccaaaatcatatctaagaaaaatgaaaaaaacagttttcctaatattttgtgaatgggtattgaagtttgggataaaaatttcagcgacagcattgagaacgtgaaaaatagctctgctgatagctggcagctggcagctagctaggccatgatggtcccagctggatgttaaaaaacactcatagaaataaactaggcagacacaaggccaccccatggccgtgtttgaaacaagacagagacaaggcctttctgctatcacagaaatgactaatatgaggcattgctgctcctttaccaacgacgtgtctagccctactttaatctcatcttctagataaacactaagatacctaatcactacattgactctgtttcttgaaagcatctaatccagaaatggcttctactttctgaattcctccttagaatcatgcagccagctgaactctgtaagaagctttttccaatgccctcttactgagatgcccacactctgaagtgttttacgctcttgctgcaataaggtaaatattcttaattttttgattacagatatgttgcttgtaatcttggccagagggctttcagagtattatgtagggattcaaacaatgccatattacaaataacttagcaaggtgatgagctctacaattctagaatatacatacgaagggtttgaatgaaattgtttcataaaatataaatgtgccaggtatttctaaatgagtgtgttattttataaaatgtaagactgcaaatatggaaatgctactcaattaagaaattgaatataattagacatttgacaatctcatccatatttctaaatgtttatgtttacaagttgcccaaaaatctattataaattttttctcttctcattgggaaagtgaagctctcctcaagtttatgcattgggattagcatttattcaacctcttatactccaagacttttttttcagttgtaaagcaaacttgtatttatttatttatttatgagatggagtctcactctgtcacccaggctggagtgcagtggcgtgatctcagctcactgcaagctctgcctcccgggttcatgccattctcctgcctcagcctcccgagtagctgggactacagatgcctgccaccaagcccggctaattttgtttttgtatttttagtagagatggggtttcaccatgttagccaggatggtctcgatctcctgactttgtgatccgcccaccttggcctcccaaagtgctggtattacaggcgcgagccaccgcgcccagtcgcaaacttgtaatttaaaaaaataaaatgttgctatgcatttacttataaattattaaatgcctctaatattgttatcttctttctagaagtcctctcccaacttattctggtgttattggcatggaaattgtgctcaataaatgagtcagtcaaaatagacttgttcatttcaggggacaatttttgtctgttatctctctattgatttctgttgctacaagtgaagttacaccaggtaaatgagattgtacgcatggcagatgatttatgaaatccaagtattgttttaagtgtaattatatttatttcggcaacatttcgaccaatgaaataccatttgacctgctataccgtggataaatcttgagatgcacatcttttgtgagtaatatattaaagattgttaggcaaaaaataaaccctaaggaagtttttaaaaatgttaagatgttgatgttggcagtagaacaaactcattgggagaaaaaaaaacagcttcatctagttaattaacaacaaaacagctgggaaaatgaatcatccctggttgtgactgactgtaattgaaaatgactaatgatgctgtcattttgcagttcatatctgaggaaatgatgcctggaagattataattgccctcttgaccatttgtctacagcaattattttgtgttaaaggttgggatggaacgctttggccaaatacagaaagttcctcacacctttttctgttacattgaaaaataattcaagagcagtaagtaaaacatattactaggtttgtgtaagtaacattttttgataatataaaaagttagcaaagcaaaccagctggcttcattttatcactttagaaagtaaccaagacatttaaaattccattaatgctctcagttctaatacatggcaggtgatgtaagcattgaaagtacataaacatatttttaaaagttaactgaaagtgtagttttccaacttaagttaaaaatgagtatgaatacaagaaaatggcacctaaatgcttaagctcaagacagttaaaaatacaattttataataaaaatcaaataacaaatggcttcttttgtagtttatattgttgttactgatagcagttgtttttgctgcttttaaactgctaaatggggtgctattgaggacctagttattactgtgtggaaaaatggaacacattaaagactatttcatctatggcattaatgtaatatattataccaaaactataactttagcaaaattttaaacaatttatataactcatatagtcagtcttcagtaatttctgaagttaagatgaagaaataacatacaaataaataaaagtatgtgtgtagatgggggaggaagggggagagagagagagagagagggagagagggagagagggagagagggagagagggagagagggagagagtggagagggagggagggaaagagagagagagagagagagagacagagagagagaaagagagttgaagtgctaaacaaagatggagaggtatttgatcatacgatcctaagatttttccagttattttgcagcagagattagtactacctatacgtcattagtattatcatttcataatatgtatttgaccttttacaggaagtcctcaaagaaaataaagaagttggttagtcagagattttaaaaaagaaaccagaaatataccatctttgaaaataaaagaaatcttaaagaagttgacgaagtgaaggaaagaagaaagaggaaagaaactgagcagggatgaacccagcttccaatcagaactcagcttgggaggtgagcgtaggagctggacagacaggctgtctgatgcagaatgcggaggtgccaatagacaagtcaatttcctaagaaacagaattgctccctgatgtgtctttaattagaatgtttgtaagcggtggacacactaattatgcatttaaatactagatcttgcatatacatcgtgagagattttcattttctttttaaagaatatcattttcttcataattattacagtttccaaatgcacctcccccaaaaaacaaaaacagaaacacaattctctcatgaaaatgtgctgcaggctactcagactcatttcctcttctattaagaggtaacaagacccagagtgaagaagaggcattataaataggacaaattttaaattttgatatatggactcaaagtttaaaaaggctttgttcacgttctatcagagcaatggagtgtccttcagaaaaatcatctctaacctttaaaaataaatttttgatccatgcagagatttaaacagccctcacagctttctgccttgtattgctgggtgtcatgttcaaaactgtgaggtcattttttgagcctctaggtgtttcaggctaccgcaaaccccagctaatcttcagatgtttccaaggtcatggtccacagcaaaagttgtgcgtgagtcaactatttttttaaaccccataattctcaaatcattcttgcatttttgcccctatcaacttgatatatatatattttgagacggagtttcgctcgtgtcgcccaggctggagtgcaacagcgcgatctcggctcactgcaacttctgcctctcgggttcaagtgattctcctgcctcagcctcccaagtagctgggattacaggcgcctgccaccacagctggctcattttcatatttttagtagagacagggtttcaccatgttggccaggcaggtctcgaactcctgacctcaggtgatccgcctgcctcggcctcgcaaagtgctgggattataggcatgagccaccatgcccagccaacttgatatgttgatttttctccaaatccaagggagaaatgggaagacaggaataaattttcccttaagttcagcttctcccaatgtgtcaaattgagagaaaatagggaaacagggaaggagaaaaaaaaaaaggaaggaaaaaaacagtgctgtctgctacaaaaatggttttaagggttgtgaaagagaaggaaagcaacagctcctggttctttctttttatttcagaaaagtaattctccttttacatcactaatgcatcagcaggaagcagatatgctcaggcatggcagatcccagttctgatctccaagtggcccagtagttgagtgtgtgggtggaggtgcgataagttagcatcaagcatttggattgttttatacataatgaaagcaaaaattttctcagtggcttttaattaagatctctctctctctcttttacaaaggcacaaaagtaaaagccaaattacatgtacctttgtgatctctaacaattagtgacaaaccttaattcatagtcatacaccataaggcataaagtctttgaggatcaacaaagagtagatagaaacgtatgcaattgtccatttgtgcactgcatggcttgctacaatgaaagtcaccatattaactgctctgagggctggctttcttcagaacatcaacggaaactctgaaatttgctgctttcaggactttgcctagctcttccaactaaatactgagcacattgttagcttatgaaaaatgattatactgggcttgaactggatacaaactacttttctagatttttggagtggttgcaatatatttctgaataaaagtatgttgatatctacagagaaacctgtgattttcagtgtctggtgtttggacattaagctcaggtgcaaacttcaactctacctaaggaaaagtctcttgtaagctgtaaggaaaacaaacaatcttctagaaatgaagcttgggccaagcgcaagggaaactaagcagcgaccttagagacagaatctaagtcatggtaatgttgtttgcaaggacaaactggttctgtataatgaggttattgacctgaactgttttcaagcagttttaaacatgaggacgaggttcattgtatccaagcctgcaacattaactgagaaaccaagactgatcaataaacagccatgattacaggatctcaggaaccttcatcataatgggagccattataattctggtcaggtacagagaatcaggtaacctactgctaacgtatatttagcactggactctcatttgcaaatggaagccattgattagctattttttgaaaactgacctggctttccatctccctccttatgtaatagcctgtgaataaatgtgacctagacttcaacatggatatggagaagaaaaaaaagtagaaaggtttatcccaggccagctttttgccaaagaaataagcaattacatgacatttcactaaaaattcttgacccaataaaatactgaagcctcaatgccgattttactcttttataagaaagagcaacaaagaaaagaaaggtcacggaccatattgtgattctttacagctgttggagacagacactatgatgcagtagcttgatttgaattaaaccaaacaatatgaaaagcatcaaggctggcaagcaaagcaataaagccccaaagaatttaatctaccttgaaggtgggactacttttgtattgatggcagcacaccaggacagaaatgagtcctttaaagcaatgactcgttaatagccttaagatcacaatatataaataggatatgctgatcaaaaagacagctttgcctctgctattacagtatggccagtatttccttacaagttatttcactgattataaatagtccacgtcaatggcaaatgtacaacaggggaagcataacccattatgaggtaatggatattgctagaggttgcttcattaccttcactggctgagtggctggtttttccttgtacaaatgctgccctttagacaaaatctcttccacatccggttgtttagcttgaactgctatttcagtttcctggggaaaagaacccatatagtgcagattaacttcacagttagcaataaaattactaaatttaaatatacccttggagactccacatgtattgcagatcaatttctgcctggtacataagggcacaaaaatgtagcttttggtgcagagaaaagaaacagagatgtgaaacacattaaacttaaaaaaaattcatccaatatcttcttgaattatataatactcatatagaaacacaggcattaactacttttcaaaaaagtaaaatgcaataatgacaatacaatttattaacataatttatatgaataaacactagttttagctacaataatctcaataatcctaatgttcattttactttatacacttattgttttacaaaattctgtgtttagtattggatataaattttgttttgaaataaatatcaaataattatttctacatcactgtcaaaattattttctttccaaagggtaaacacttaaagcacagtatcaaagcttattatttattaatgagtcaaacaggccttctgaagaacgattaattttgtttattatttgcttttcttcagtctggagaaggctgaagcatgacaaaaaaaaatccttcaggtatatgaatataagcattttgttactgtctgctgactagctctcttgatgagacgacaaaagaattgtgcagaaattgaagctgaaggaagtgaagttaaatattacagaagactttttggatggaacacttgttaaacactaggatagagtatcaattaatcaatgtcaggcatcagtcagggcctgggcaatcttccccagagagcagctcctgattaacccgtatctctcttcctccctcccctaccccggagcctcccagcactgctgtgtttaagtgtctccgtgccactgtttccttcgtatactgtgtttgtacctgttccctctcagttcattagtaggaaatcccaaattactataatctcatactgcccagtacagtctcttgcaatttacgggtgctcagcacatgctcttgagatagactatttttttccagttcttattataataaataccagcagcaaacaggcactttggtcaaaattgtacataactaacctcatgtgttaatggttatgtatgcaaatttcacttcctttataacagtagtttagctactttacatgaagaactattaattgatggtcttactgccccttgccaagaaaacacattgttccctgaaaatgcagcacccggaatgactgtatgtctttgctagaggtagaaatagctctgatctcagatgaggaataaggaaaatctagttttacttactgaattccaaataggtccccagccactataaattcacccttgaataccgcatttgcaaaaaaacattttggtgtagtaaatggtgatatggtctcaaaatactttaagagaaaataaaatatattattctaaggaagtagagaaaagagcatatcttcagcaaggtaaaaatgatttaagaaaaggaaaaaaagtaactgaattttcaacctatacatttatcatttatgtataccataaattaccaggccaaatatacatgtacaatgtctaaattatacatttgaaattatatatgcattacacatataaactgacaagttaacttaaagcactgtcaccaccattcattttgtatgtgtttctctaagacaaagcactattttctatttattcactgacagctgggacttttcttgtgatagttattgatatagctaattactggtaatagacaatgttttctgattagcttcatcatagctgtagactatattattgatgatagcatagttaccattcgtataatgactactatttgccttccccaaccctgattccaacagattgccactttacagataagaaaatgaagcaagggtgggtgggatagtagtgacggtagtgacaatgatgtgaatagcttgcccacaacctcgtgggatgtgggagagttaatattcaaacacagctaggtctgaatccaaagtttatactattggcagtagtaacagctacgtcttcatatcttacaacaacttaataacatatccaaatgatttgatcaaattatgttatttctaagcattaagaaattttactttcaccatctgaatctgtttgatattatcacatatgctgaaaaacatgccctacctctctgataatagagaatcactatgggtcagagggagacaggcaacttaatgcaacagtcgtcattcccattcattggaatttttgaaaaatgatagcaaagaccattgttcccactgccaacctacagtcttatttaaactgttccaactcctttgcttcctccttcaaaacacatcacaattaatcacattatgtgtatatgtatagttttgaccattcctaaagaattatcctctatgagagtaagacccataactaccttgttcactcatatccctggaagtgcctaacacatagtaagtgctaaacaaaaaaccgttgaacgggcaaataaatactgttgcaactttgagcctatgggaattgagttaagagtgtgtattactagagacatttgttcacgcagacagtcgaaaggttcatggcatagactattttctttctaaataatctgctagagttaaatacagagtctactcttctgcttttggatttcccgtaatgattttttttgcaaaattttacatcttcacgttattgattacaacaatgtctcagaaaactcatttctatgacaaattaaaatgggattattttatacttaattaatcctttcattgacttcctttaaactaaaattccatttatcccacatttttcttcttagctgaatttgtataatttaatctccatctagcaatccaagagaacatcacaaatacaaatgttttagcatttatatgatttagcatgaatattttatataaccaacatctgaatgtgggacctctaatcaggtactttataactattgcacttgaagcatagtaaacatttattagttttgatttgtaattccagtagaagagtaaacttggaaaggctggaggatcatatttcctatacaaatctaaaaacttctatgagtattaaaacctgtgatgtactagcatggaaaagctcatctttcctttcaaacactcccacttcacttttctttttcactcatcgagcataggaagtcaatattctcctcatattcccttaaatttaatgtgtccctctgtcccccaatacagatcatttgtatttgatacatttgatctaacttttgttttcatagtatttatacattaaaaccttttgcactgaacaccaaactacttatattattccaacctttaaaaaagatttatatttctaaaattggagtgcgtattcaaaagatacctgctgcatcatctattcaatatatttataagctagagattgggatacagcactagaaaattttcaatttacaatatgaatatatgtgtgtgatatacatgtatatacatatatgtgtattagatatgataaatacacatatcaacatatatgtataatatgcacatataatacacatacacatatgtgtgagtggatatatagacacatgtatgtatatgtacaggtatacctcattttactgagttttgccttattggctctgcagatactgctttttttttttttttttttttacaaactgaaggtttgtagcaaccctgcatcaagcaagtctatcagcaacatttccaacaccatgtgcttacttcatgtctctgtgtcacaatttgataattctcacaatatttcaagctttttcaatatttttataactgttatggtgatgggtaatcagtaatctttgatgttactattttaatagtttcagggtgccacaaacagtgcccatataggatggcaaacttaatccattaatgtatgtattctgaacgctccactgaccagtcatccccctacctctcttcctctccttgggcctccctattctgagacacaacaatattgaaattatgccagttaataaccgtactatggcctctaaatgttcaagggaaaacaagagttgcatgtctctcactttaaatcaaaagctagaaatgattaagcttggttaggaaggcatgtcgaaagccaagagaggctggaagctaggcctcttgtgcccgttagctaagttgtgaatgcaaaggaaaaattcttgaagaaaattaaaagtgccagtctagtgaacatgcaaatgataacaaagcagaacagccttattgttaatatggagaatgtcttagtggtctggacagaagatcaaaacagccacaacattctcctaagccaaagcctaatccagagcaaggcccaattctgttcagttgtatgaatgctgagagaggtgaggaaattgtagaagaaaagttggaagccagcagaggtttgttcatgaggctttaggacgaagccctctccgtaacataaaagtgaaaggtggagcaacaagtgctgatggagaagctgcagcaaactatccagaagatcaagctaatatctaagatgatgaaggtagctacactaaacaacagattttcagtgtagatgaagcagtcttctattggaaaaagatgccatctaggactttcatagctagagagaagtcaatgcctggcttcgaaagttcaaaggacaggctgactctcttttgaggggctaatgcaattgatgactttcaattgaagacaatgctcatttactattccaaaaatcctagggcccttaagattatgctaatagactctgcctatgctctataaagggaacaacaaagcctggatgatagcacatctctttacagcatggtttacttactgaatattttaggcccactggccatacctattgcacagaagaaaaaatctctttcaatatattactgcttgttgataatgcacctggtcagccaagaggtctgatgaagatgtaccaagagattttgtttttatgcctgctaacacaacatccattctgcagtccttggacaaaggagtcatttcagctctcaagtcttattctttaaaaagtacattttgtaaggctatagctgccctaggtagcgattcctctgatggatctgggtaaactgaaaatcttctggaaaggactcaccattccagatgccattaagaaaatttgtgattcatagaaagaggtaaatatcaacattacaaggtgtttggaagaagtttattccaaccctcatgaatgcctatgagggtccaagactttagtaggggaagtcactggatgtggagaaaattgcaagagaactagaataaagtggagcctgaaggtgtaactgaatggccgtcatctcataatgaaacttcaatggatgaagagttgctacttatagatgagcaaaacaaagtgttttcatgagacagaatctactcctggtgaagacgctgtaaacaatgttgaaatgacaacaaagggtttagaatattctgtaaacttagttggtaaagcagcagcagggtatgagagccttgacctcatttttgaaagatctactgtgggtaaaatgttatcaaataacatcacacactacataaaaatcttttgtgaaaaaaatcaaccaacatagcaaacctcatggttgttttattctaagaaattggcatagtcactccaacctttcaacagttactactctgatcggtcagcagctatctccgtcaaggcaagaccctccatcagcaaaaagattaagactcattgaaggctcagatgactgctagcaagctttagcaacaaagtatttttttaaataatttcaactattgttttagatttaaggggtacatgtgcaggtttgttacatttatatatttattgggtgatactgaggtttggagtatgatggatcctgtcactgagatagtgcgcaccgtatctaatagttagtttttcaactcttgccccttccttatctcttcccctactagtttccagtatgtactgttgccatctttatgtccatgagtgcccaatgtttaggcccacttataagtgagaacaaagtggtatttggttttctgttcctactaattcatttacgataatggcctccagttgcatgcatgttgctacaaaggacataatttcattctttttaatggttgtgtagtatttcatattgtatgtgtaccacattttcttcatccagtccaccattgatggtcatctaggttgattccttggcttttctattgtgaatagtgctgcagtgaacatacaagtgcatgtgtctttttggtagaatgatttatttacttttggatatatactcagtaatgggattgctgggttgaatgacagtgcattttaagttgagaaatccccaaactgctttccacagtgggtgaactaatgtacactcccaccaacagcgtataatgttcccttttctctgcagcctcaccaacatctattgtgttttgagtttttgataataggcattctgactggtgtgagatggtatctcattgtggttttgatttgcatttctctaatgatgagtgatgtggagcattttttcatatctgttagccacccgtttgtcttcttttgagaagtatctatatattcatgtcttttgcccactttttacatggggttatctgcgttttgcttgttaagttccctatagattatggatattagatctttgtctgatggatagtttgtgtatattttctctcatcttgtgggttgtctgtttactctgttgatagtttcttttgctgtgtagaagctctttagtttaattagatcccacttgttaatttttggttttgttacatttgcttttaaggacttagtcatgaattctttctgaaggctgatgtccagaatagtatttcctaggttttcttctgcgattcttctagtttgagattttattgtattgtattgtatttatttagggacggagtctcgctctgttgtcaggctgaagtgcagtggcgcagtgcaatctgggctcactgcaacctccgactccctggctcaagcggttctcctgcctcagcctcccaagtagctgggattacagggatgcgccagcatgcccagctaatttttttgtatttttagtagagacggggtttcaccatgttggccaggatggtgtcaatctcctgacctcgtgatccacctgcttcagcctcccaaagtgctgggattacaggcgtgagccaccgcacctggctgagattttatttttttaaatctttaatccatcttgagttaatttttgtatatagtgaaaggtaggagtccagtttcattcctctggatacggttagccagctatcccagcaccgtttattgagtagggagtcctttccccattttttttttttttgtttactttgttaaagatcagatggctgtaggtatgcggctttatttctgagttctctattctgttctactggtccaagtttctgtttttgtagaagtcccattctctttgggtaactgtagccttatagtatagtttgaagttggttaatatcatgctttattcttttcacttagcattgtttttactcttcagactgttttttagattcatatgaattttaggatagttttttataattctgtgaaaaatgacattgctagtttgataggaatagcattgaatctgtagattgctttaagcagtatgtccattttaatgatattgattcttcctttccattaacatggaatgtttctccatttgtttgtgttatctatggtttctttcagcagtgttttgtagttagccctgtagagatctttcacttctttggttagatgtattcctagatattttattttttgtggttattgtaaatagtttgcattcttgatttggctctcagcttgaacactgcaataacatatttttaaattaaggcatgtacattagtttttaggcatacactattgtatacttaatagattacagtgtagtgtacacctgacttctatatgtaccaggaaaccaaaaagttcatgtgactcactttattatggtggtctggaactgaaccttcagtgtctcagaggtatgcctgtatatgtgtatacatatatatatatatatgtatatgtgtgtatatatatgtatatgtgtgtatatatatgtatatgtatgctatgaagaaagattaaaaagagtaagtagagagtgacagtgggctctattttaggcaatgtgagcacagaagactgctcctctcttcaggaaatggaatgaagtgaagaaatgagtcatgtcaacatactgaagactatttcaggcagagggaaaagcaagttccattgccaaaaggcggtgaggagttttgcttgtataaggatttgaagtagtacaatgctctgttaacataaatatgtacagaatcattcaggtgttatagaggacagaataaagtctctctctctctctctctctctctctctctctctctctctctctctctccctctcctcccgtccctctctttctctcaagttgattgtatataccaagagcttagtactttgtaatatttcttggataccaaccctgatttgactcttttaagatgataactctagcggcagattggaggcaagattttaaggataaggggctggtggaagaaacataggaaatgcctttagaggtccgagtacttattgaacaaacaggagcagcacggatgttcaggaagtattattcctatgttgtggataaaggactggcaggacttgatggggaaaaagaaaattttcagaatcaccaagattttataacttgggagaaactgtctaggggtacagggaagacagaggagcctgtccctatatggaaggaataatgttttcaggttggagacatgagtcaagatgcctgtgattaacactgatgcaaatgtacagaaagtaattgcaaaaagaagcgtagtgtgcagattaggggtaaggctaagaatacaggtttggaggtaaaaatagtagttggacaatattgtcccagtgatacttgtagagtgactgaagaggatagagccagaattaggtattcgcctccacaggataagagaagaaagttgaaccaagaaaagatagaaagagcagaagagactgaaacaagaacatgtaaaaacccaaaatagaagtgaggagagaattatatgaaaaggggtgccaccatgttacatattacagataagcaaggaagctcaagaaataatacaaataataatactgaatatatccttcattggaggttaaatgaaataaggttttatatccaatgttctcggtttactttgtaaatactagctcgtggtcccccaaatttactacatgttcccatttttaaaattcagcaaacagatttaggtaacaacagtaaacttactagatatatcttacaatgggagcaactataacaaggtgagtaaaacaaatgaatgggaacgtttgctctggaaaatcaagaaatacacacacacacacacacacacacacacacacacacaatctttaaggatagttattaattatggaagaaacaaacctaaaattatgagagtattaattcatcctatatgataaaaattcttaacattttaaaaaagtcttgcaacactgtaacaaattcaaaaggctggatatttcttcctttaaaattgcttacaagtacaatccagtgaaaattctgtacctttagaaaatgaacagaaatagtcaaaaatttcatctgtgtttcttgtgtgcagccaaatgactagcatccttctctatccactccatattcttcaatcacccataaatagttccaaaaatcatgaagaatagataccactactcagaaggcactggcagatagataggatcaggagtctgctttgacaactacaaggaatttccttaagacatccacatacaaattttaattaataaaattgttattggcgaataaacagaaatggcaacaaggctggcatttgagtagtccaagtattacttagagctccaaagtactaagtgggtgcttgctacatgatggactgaagagcaggtggcatgccaaatgaaatgtccatatttttcacttgcaggaagtagaatattccctgttcaagtcaccaaaatagccctagatttagtcctctggtgaatgaacattgcatactcacatcatttccctctattgaaatgtttcctattaccgtgtccttctatcatcactattgtcatcttttcatccttcaatgacatagtacagattttaagtacccatatgagatttattctcagttctatagaaacagagcaatgggtgaaagaattcatttcagctctaaattctttgtggctacttttccttggcacatttttggagaactggacctctaattaaatgcacctttgatagatcactttagaaagaccattttgaagataaatttctacaatttacctcactacatttatttgcaggttgaatttattagttcaaagataggtcagttattaagggcaagatactattgcttgaagggtcaactgtagtaaatccaattaacttcactgaaaatattctttcgtacatattttcttcagtgagtataaggaaaataaactgtaagaaactgacaattatcctaaaaattaaagaatatgtgaaataaattgtaaaatttgttatttctccatgcaaataaaatgtgacatagaaaagctaaaaaacaaagcaagaaacaactccaaagaaaccacatgagatggaaagatcagaaaatgctactaaaattattagctgtgctgaaaatggcaactaactgctatagtgatattaactgctgtgataatattaacaagctacagttgctaaaacatttattatatgtcaaacactgtgcttttcatacacacatacactcctacaaagaaagttttatctaatttcacagatgctgcaattgagagagattaggtcaattatccaagaccatgtggcttgcaaatggcagagttgagattatatccaggaagtatgtgtcaccaaatctctatttccttctttctgaatctgttgtgtatactgtgtgtgtgtgtgcatacacgcacatgtgcatatatgcttattatttctttccaaaattgacgtttcttaatattatgttaattatttctcctcctcttgaactcaaatacattctacaatattcttccagaatataaatgagagaaaatcctgtcccttctcacaaaaaatgaaataaagttttacatagccttgtaatagctctgagggtttctcttagtgggtttatgattgccaaacctctgatatccaggtcagagaactggtttgagcaaaccttttatctcgcaaatggcctcacatctttatatgatttcagataaggtgaagaaggccaccactaaaatggaaacatagctaattatagtggccggcttgtgtaaggagaaagtgttcaacttcaaagaacattcagacaagaaagtcgtcatgggatttccaccaaaaagtctcatttctaataacagaacatttccattaaggtttttttttcctccatgccttattcttaatgtcccctccaatgcaagattgtgtaccaggtgttaagatccttatgatacgaggagagtttgattttcttcatagtattgatagttcactacaatgtcaggtataattttaagaaaataacttgtattaattaggtaatagggagtaatggttcaataacagtaggagaatttcatggtctcttctgaaatccagccctgataggtttttgaaatggagtaactctaagcacctttacttttatttatctcttattaaatggcattactaataatgggcagttgctgatctgacaagcagtgaagcaaagattagtgatgaaaagaggtagaaaaaaaaaacccttgagggtaaaagtagcaagtcagaggcaaattaatatatatttacattttctaataattgatttattcaacatatttctaattctacatcatgccgattgtgtgtgcgtgtgtttaactagaaatttggtgttcttagaaatagtacaaaaaggaaaaaattcttccttgttttcctttcttgtactcaatttctttaaattttcattttacctactaataaccttagaatatatgattatatatatattaagaatatatatctcaaagcacattataaggaggacataaacaacctttccatgtatgttcaaacatttatttatttatttatttatttatttgctcattcgacaaacatttattcagtgcttactatgtttcactggggtaggaatggggagtgcagacacacaaatatatactacatttagagcaggtcaggtataacaactagtaaagtgcaatgtataatggagcacagagcaggaactgatcacttttgtgtttgatagacaagaaggtcaggacagaaaggctgggagcagaaacagctcatgcacctcattataaggggatggacggcagagagaatgtattccaagagggaacatggaacatgcaaagacaggaagcagaagaagtacggagctatcacgtaggggaatgggaagtaatggagtagaaatagaaagcaaaagccagagaaaagaaggatcttgtataccaccctcagaactgtagtggagaagctacaagagttttaaataagggaatggcacttatgttttccaattgatcttctaaatatatatgaatatatatttataaatgaaggtatatgaatatgtgaataaatagacataagatctactattaatgcttggttttctaatcaaataagctgatctgaatgagatataaatattgctacagaaaaaagaaattcaagataaaaatgacaacttttttgtaaacattaagtgtccattcacttaattttttttaacttttattttaagtacacgtgcaagtttgttacataggtaaacttgtgtcatgagggcctgttgtacagattatgttgtcacccagatattaagcctagtacccattagttattttttctggttctctccctccgcccaacctccaccctctgataggccccattgtgtgttgttcccctgtatgtgtccatgtgttctcatcacttagctcccactcataacttacttacttataaggagtgccttctaccatttggctattttgtcaaccccacaattaacagtttttctatctaatctatcattgatgataagggccactattgttatgtaaactaagaaagccaaaaaacaaaaaaacctacactttgtaaacattatctattgtacgatatatctcaagttcagaggtgttgaaatactaaaaaatgcatttgggaatcaatgaaatcctaagacatttgtggatactatggttgatttgtcagttcattattattcatttcctctcttaatatggctgccctgcagtgaatatacttcccttcccattgactttgggcttgactgtgtacctttgaccaatagaccatggacagacagaagggactgtgtggcagctcttagctggaactttaaaggcagttcaagatttgctggttccccttgttcttatcttccatcatgagagaataatatgccatataaaagctgctctttccgctagggtcctgggatgagaagacatttagagcagatccatattctagaatgaaaagaccttaacttgattcatagtgtggagtaaagctgcagctgatctgcagacacatgagtgagtaataaatgtttgttgttatatgtcactggaattttgtcattgtttgttactgcagcaagagctgacaattacaatattatagtaaaacaaacaaacaatatgtgatttctgggacaaaaaaaccaaagtaagcctttaatataaatgtgccctggtcgcatatattgactgcactatctctcattccatacagaaactgtttgctaaaaagtgtagcaagaaacaaaatatgaaatggaatcaatattgtgttagagcctgatttctgcagtccagattgtcagtcagactctgacaaatgaaggctgatggatggaaaaacacaacattgttcagttgagtttctttgtctttcctctcatgttgggtgactgttcttttacttaactacaattaggtttgctagaccactgcaacacagctctctttcactataactgcatgctgtcaagtacgtgccaacctgattgacaaagaatgacaggttctctcttcccattttgaactaatcaagggcagctcaccaaagggagacttaaaaaaaaaaaacttagagatttatggatttcaaaaataatctgtccaaatatacaaagcataatgcagcattgatttttaaactggaaagtgttgtgaaactgtgaagatataatctactaagctgcatacttgaaatgttcaaggccagtgaaagagtgggcataggtgtgaccatcaagtaacatccagaagcctctatggaagctctccaccttaaagtgggggtttcaaagtctttttggcagaattcttttggcaaatgaaatattaccaaaactcttccaaaaaatcacttgagtcattccataaatattgacagattacttattgtctgctaaacattgtttgaggtactagatatgtaacagcgaataaaacagacaaactttttgtgtcctcataaaacttacattctaatggtgataatgtgtagtaaaagagaaattaaggtgctttggagagtgaaaagtgctaaagaacaaaatgtaaagcactggataggaataagagacttaggtatggggcaaagggaggtggcatgtggagagtttagaaagtgcctgcagggaaagcctcactgagtaggtggtatttaaataaagatctgaaggaagtgagggaacgattcaagtagctatctcaggaaagaacaatctgtgcagagacagcaagtgcaaaggccctggggcaggagtgtatgtgtatgttcaattaaaaaaaaaaggacaccagggtgagtggaatctagtgagcaaggggagagtagtaggaatgatagtcatagagttggggatggaggaggataggtcctgcatctttggaaggatcttggctgttatcctgagtgagattaggaagcataggagagttttcagcagaggagtgatgtgatctgacttatttttaaacagatcattctggctgctgtattaagattagactttaagaatgcagagaacagatggcagttaagaacagattcttaagggggtacaatctgcattgtttggatggaaggactttgtgaaaacctgaagccattattttggaaaactttatacatacagttcttaactaagggccaaagctctggtctggtttaatagcagcacaggacactgcttagaagaacattcatttaaactggtactcccaggtcttgctgccttcctaagtccttactggtgaagagtatgggctcttgagtctggttatctaggttccaatcctagcatgaattgactatttccaacagagaccaaatggcccatgaagcctcaaaaactgactgaaatttttctatttggccttttaaagaaaaaagttggccaacactgatgtagagaaacggttaggttcaggctctgtggctctaaaatccttcaagtatgcataattattccacaatgtaaacatatatcaaaacatcacattgtacctcataaatatatgtacttattatttgtcaattaaaataaaataaaaaatacaggggtatttttaataatcaaacattagaaacaaatgcttttctataaactccttatatagactcatagaaagagttaaacaatttataattagaatttatttgtttatttatttactattttgacacagtctcgctctgtcgcccaggctggagtgcagtggcatgatctcggctcactgcaacctctgcctccccagctcaagcggttcttgtgcctcagcctccagagtagctgagattacaggcatgcaccaccaagcctggctaatttttgtgtttttagtacagacggggttttgccatgttggccaggctcgtctcgaactcctggcctcaagtgatccacccatttcggcctctcaaagtgctgggattacaggtgtgagccactgcacctggccaatttgtaattatactttagagcagaggttagcaaacattttctataaaacaccatatagtaaatattttagactttgtgggccaaactcaaattctgccaatgtggcatgaaagtagtcaggtctaatacatgaacaaataaatgtggctgtgttccaataactctttatttctgaaaataggtggaggactaaatgtggcccttggaccatagtttgctgactcttgctttaggatattacagtgttgttggaaataatcagtctagaaataagaacatctgggttctaggcttattagcccatgagttggggcaagtcatttaactgctctaagtttcaggtttcagtatctttaaatataaaataaatgaaactaacagatattactgtgagtaaagggttaaaaacaccctttgtccatctgtatgagaatttgtactttgatcaactttctagctcccttctccctagaaaactgataaagttggaatgtcaaatgtgtgagcaggcaacattgcttcagattaaaaaaaaaaatgatggggactggtaaattacaccttggttaggtgttctacatatgaactataaatacctaatggaaaaccataattgtggggcgtccccaagtacaacaattcttgtaactaagcatgtcctttttgaggaccttggaaactatgttacaaggcattggcctctgggatgcataaggcttctaggccagggttgacccagcatctcgatttgtttccttcctgtgcacctgagatgtcatgagagagtggacaggtgctgcaaagtgaatagctcttggatggctccctgggtgcttcagagattgctacgcatactcatcctactaaagagagatacccgatgctaccttcctgctaagctatattcctatatccttctaagtgcctttgctactgaatgtggtcatagtattgttcagttgcacctaatcaaagaagacttactgttgtgttttacaataatcaattataagactcacattttatttcaacaggttagctgctctgaaattgggacacgttttataaatgatagcgtgtcatagtctaaaacggcagcacatttttcttggtgaaaaataaaataacaatgcatactctaatcaatggtatcttaaaaacagtaaaatatggaaagtgatcaggcttttcatagtaggtcaggatgaaatgatttagtacatgtaaaggtaatactgctaccatttgttggaaactgactaagtgcaaacactctgctatgcacttaacataaatcatcttaattaatctcaatctccattgcagagcctctcagcaatactattaccattttttcagattaaaaaactagagtcacgaaaggtcagaaacttgcctagggcacaacctaacatatggtgaatctgagatttgaaccctagtctttctgaggcaaatcctgcatacataattactatgctacagggtctctggatttaaatattgtaccaataaaaagtaggttttatttgatgaatcctacggctcagaacggaacaaagtagtttcgattaggatgtaatgtgagtttcaatcagggtttctcagcttcagccctattgccatttgggactggataattatttcttgtcgggagctaccctgtgtactgcagggtgttttgcagcatgcctggtcactatgcacaagatgccagtagcactttctcctcccccatgtgtgacaaccacaaatatctccagcaattgccaaattcccctggaatcatctgtggtagagaagcattctattattgaatacatgaaggaacaaatgaaagaatgtctgttcacggtctgtattttcagtgtacatgaattaatatgacatgatatgaatgtctttccttcctttctcttatatacaacattgtatgtaatgtcatctgttcatatactctttcagatgcacttttatcacgctatgtctcttaacattcatttgagtgtggttctgatgaattctaaccatcatggcatgtttcagtttctggctgaatgggtcctaatatctctggattatataccccaaaaggattagggaatacagtagatctaaggactagaaaggcacatattaaacaaaagtgattttgacatatctctgaatagtggccagtgatatttgcattattttaaaccaatatagagcatctctaagttattatccatatagtaattggacatggttctttaagtcttaacagaatatttacttaaatctgttattattaaacactagaagttgctttttaaagataaaacagccattaggctaattttcattaaaagcaaagaaaagagcaattcaattctgacttcatgactgacatgcactttaaataaaattaaagatgttttgtttttactattaggttctgtaccaaaatcatagtcattatctaaaacaactctttctaagtgctaccataactaataaactcaagcaatcaaatgggtaattgaattaaactcgtatttttttaaaaaaaaacagcaacaatatatctgcattctctcttctgaatactcttcctaaacatgtacaggaaacagcaaatatatgggtttctgaaatcaagaaaaaggacacattatgtaataaagccaattcctggtttactcaatatgtcagtcttcatctgtgataccaggtctttagactgttgcacttagcctttatacacttataactcatgatttccatatgttccactaagtagccattttcactagtctcctgaaaagtcaacgataagattttggataaggaattgtagacttatatattaggtgcatataatccagaactctactagaatctagaatatacagacaactcatattaatcggtaagagaaagtaaacaatccaacggaaaattggggtaaatatatgaagagtcaactcacagaaggaaaaatctgtccaacaaacttgaaaacttgttcaaccagggatatgcaaattaaaataataaattcctgccacttcttgctgctggtggaaaagcaatttgcaatatatgataaaattaaaaatgtgaatactctaatgaggtaacaattccacttctaggtgttctcatatgtctatctgaggagacctacagagaatgttgtttcagcattgttcattagtgaagagctggaacaatctgattattcactgttaatctaacgggcacattgattgtttggtttctattaaaatcaagaatacttttaccagattacttctgtattctaaagccattaaaaatctttgttcgtatttttatggagtccaaagttctatttaagctagtcataagcaaagttaatgctactattcataatggactcattgaagatactaaagataataaaataacaatactatctctaacaaattggactttagttacaatggcatacacagtacaatgtccaaataacatctgttcagttttgagtgaagcacaggaacgtgtatgtatgtatgtgtgtgtgcataatttgtatttgtgttatctctccaattatgtaaatcactaatacttattactatgctaataccagaagacgtattgtaataaaggtcacatgaattattaatttttgtgtttcttatcacctatttcatcaaataattttaaagacagagatgctatctatccacactttctctacttgtcattcacaaaagttccttcaaacaaatcttaaaaattaaaagtatgcgcacatggctttgtagtttcatgtttcagtaaggagaattttacttggatcctatacattattgtgagtgcttccatgttttgccttcttaatgcttaccaaaattattaatgtcaagaataccaatcttggccaggcatggtggctcacgcctgtaatcccagcactttcggatgctgaggctgacggatcacttgaggtcaggagtttgagaccagcctggtcaacatggtgaaaccctgtctctactaaaaatacaaaaattagccgggtgtggtggtgggcaccagtaatcctagctacttggcagtctgaggcaggagaatcccttgaacccaggaggcggaggctgcagtgagctgagatcgcagcactgcactccagcctgggtgatggagcaagactccacctcggaaaaaaaaaaaaaaaaaaaaaaaaaaaaagagaataccaatctcattttaatgaccagcatgttacataatcaattattataaatgattttaagctgtttaatgttcaaattaaaacttttcttaaaatagcctaatttaaataattatggatgttttcattaactatattatttgtgccctgttatgttcggtaactgccaaatattcattgtgtcaagggggtcaccaaagtgttcagaatttggaaactgtagcttcagatgtattaaacatgcaaactctacttttttatatgtatcattttgaaattacagaacaaactgaatgcatttacactaagtaataattgaagcagttaacttggccctacggtgtttccttttcaaaatatatgtcagatatatacagagaagtgtttaatatcccctatatgcacagatacatatatcatatatatgatatatgaaatatataaggaatttaaattttctatatcatgaatcacatactgattcattcattcagtatgtgaatgcatgagtctaatcccactgacactattgctcaaaggagggtcaggaagaataggggggaaaatgatgtgaataggaaaacagtaagcatatggcaattttgaagtatttggaatacaaagttattataagttgagtacagctgacaaaaaaatgcatagtaacatcagctaactttgcctagtagatgataggggtacttatataaaatagaattgtatttgttaattagaatcataatatactcttcagtgatacagaacttaatatactaagtgaaatctcagtatatagaattgtatattcaagaggacatattgctatggcatttctaagccgtaaattcaacgcataaagtttggatgattacatcttcattggagagaatcatgttactttatgatatattttcatactgataacatctaagtttattctgaattaggatatatgaagtattacttaaaacccttcagaatgttacatagttttgttagagacatgcatctttaaattattttttagataatatattattatcatttggtaatttttctcaactctcaaatatgagtggaagtttaaattggtatgagttcttgagatggaaactgaagagtgaaatagctttatttaaaatagatacttctcctaatgctaaaacttaaagtataataaaaaaaataaaatagataattcttaaagtgttctttttagtgttcaataatttatatatatgtattatatacattatagttataatggcatatacagtataatgttcaaataacatctgttcagttttgacaaatatatatatttgtctttttctccccattgggaaataaagtaacaaagattatggccacagtttatcttgcttttgtttttcctcacagcacctgatagagagttctacctgtaaacaccaagttcactccctcctccactaaatgacaatgtaacaagtggcttcaagttgctccaactttttggaaggcatccttatacataatggataatcacgcttgtttttagaggtatcataattacaaatttagaattctaagtgttcttcagcagtaactcagagatttaagaatccctttagtaactgatatagtcagcagagaaccgtatttcctgatgaaaatacaagctcagagccacaaggtcagcagggtagagacttatcaggcagacaagaggcactgttccagagagcagagggtcagaggagactgcaagtacctgcatagagatctcaggtcatgtataatgcttcctcatctgtcaacccagctgccattttggagaggagcaggaggagagcaaggaaatctaaaagactggtcattatccatgaggtcccaacccataaaaagagactggtgaaatcactatttcagagtgagatgataattttttctcactgcccagtatgggaaagggttatgaagatcactgagaaataaatgaagaagttttcattctgagaatcaatatttgactcccggacatacccatttaacttctcctgcatatttattgtatgcatgaaaatgtatctacttaagaatctatgacagtgcttttcaaactgtggttccacagaccagaaataacagtttcacattaaattttaagaagcatggctctagataggatatagtagaataaggaatggataagtgttagcctcccagattttaattcatttacatacttatggatataacacttatctttaaatgatacgactttgtgaataaacagcttcatgaatatagctttatgagacaatggagaaaggtggccaaattttttaaaaagttatgattagaagaattgtgttgttttaagtattgcaaattgcaagtgcagagcatgtctgaatgtatctgaaatcccaacgtgttattttctaccaacagtcaatgccaccaagggaggtaacttgcaagtttaaaaccttcctcatttaacttccattgtttctgcaccgcgttctgtctgccaatcaaagccatcccctgggcattatagttagtaaaccaggtggtccattcatccacttaagcagaaattgtttgaaaatgattggaagtgttcccatttttctcctccacacagaatcagaaagagatgacacccatgggcagagcagagttttctttagagtacataaaaaaaaaaaactgatagcatggcttctgacgttctctcataacttccttcaaagtattatctaaatttccttctaaaggagtagtgaaggactgctaagtaaaaactaaaattctaatatgcagtaaaagcattatttcaagaaagtataaacatatttagggtgacaaaatgactttttaaggtttatttcaaaagcaagagaatgatctaggagagagtagaactgctttaggagaaaatggtataatattggtgaatggaaaatagaaattggaaccttttaatttctattgggtttgtttcttgtatgtcaagaggaatggtattctaactgcaaagaataaaacaaatagcagtgagagggaactggtgtccaagatgggtaaagagattagaaagcccccagctgctcagaattaactctcttgatgcagataaattacatctcagtatgctaatacaactggcaagtcaaatggcaaaccattgtggttactcatgaagactgggaaagtgcagttttgattttcacaaggaaaaataagtgtgggaataaaatgttaagcttccagatagttatttcagatttggctagaaaatgcaatgcaaagagaagccacaaaccttctttaggtaatgtattttgaaagaatgggagtcagttgacacaggctctttgcaaagacaaaccctgttctagccatcaatgtattgttagataaataagaaaatgaaagcaaatatttacatattagttaaaaattttttaaatctctacttgtgctacaatttgtcatcatgttgaacttctgtccaggattgatggctaagaagagcaaagaccattcctatgcaattcaaaggttagttttgatgttttcaggttataaccttaagactagaatctgtctgttgtagaaaacattcattaaaacctttatcatagaaaaccatgtttttacttcaagttgtaaactatatttgccttagtaagaaagagaccaataacccaaaagagaacattggcaaaaaacaaaaaagtagcaaacagtgcatagaaaaggaaataaaaatgattctgcaacacatgaaaaaattcaaattcactcacaaaatgaataaagaattcaaattaaaatgacagatatcaccatttttcttgtttagaagatcaaaaaggttgataacacactgagtgggcacgggtatggggaaaagaaacctttcctaatactgacgagatgttctatgaagagcaatttggcaaaatgtactaacaagacaaatgccagtttgacgcagccattcgacggctaggaatttatcacatagatatatttgcaacgtgtaaaatgatgtgcacaaagttatacattttcttatcttagccaaaagtcgaaacaaactaaaggctcactaattggagtgctgcttaagtgaattatggtatatccttagaacagaatagtatgcaactgtaaaaaaaaaaaaaaagagacagttctttaactactaatacagaaaataatcacctgtgtgtgtgtgtgtgtgtgtgtgtgtgtatatatatacacacacacacacagcattttactcttccctttcttataagggagggagaagagtgctatacacacacacacacacacacacacacacacacacaggcattttagtctttcctttcttatgaaggaggaagaagagtgcttttccttctgccctcgccaagccaaggaaaagggcttcaaaagaaccatcttttgaaggatgcagaaacagtatttatagtattctaacagctggctttattttaagaggacaagagtagaaaataatatacacacacacacacacacacacacacacacctacatcctattcttggaaggctacccaggaaactgaaaaccttggcagcacatggggagagaaactgtgtggctgaaagacaacaatgcaacagaggatttcaatgcttttgaattttgtactggaagaaagtatctattcaataaataaacaaaattattattattattattaaagatggagtcttgctctgtcacccaggctagagtgcagtggtgcaatctcggctcactgcaacctccgcctccaggttcaagggattctcctgcctcagcctcccgagtagctgggattagaggcactcaccaccatgcccagctaatttttgtatttttagtggagacggggtttcatcaccttggccaggctggtctggaactcctgacctcgtgatccacctgcctcagcctcccaaagtgctgggagtacaggtgtgagccattgcgcctggcctatttatattatctttaaagtctgttatacagggataaatttacccccaactttgtaataattaacccagtatgacatcactgatacagtactaattaactcattttctataaaactgtgcagattatcttaaaattcgaaacaaaaatgaagtacaatacaaatgataacaacagttccagaaaacaacacttaagcataccacacgtaacacaatgtaataacctgcgttatattctttggtaccctatgctatcttattctattttattttacccattaaatggatttcataactcatcagtgggttgtaagattctctcccgggcctgaaagcttaaggagatgagtaactcctcctttctcaggcccattcctaaggcacaaggctacttgcctgagcagcatgcaccggcgaaatagcagaagcaggaagagagccggccagaagacaagtacctctgaagatcgagaaagaggccatccgggtacaatgcagcagttacgtcaggccaggagacttcctgtttacaggagactataaaacctttgtccagtcctcacttggggctaacgccattttaggcctgaggctgcccgcacccaggcgctcattaaaacagcatgttgcggccgggtgaggtggctcacgcctgtaatcccagcactctgggaggccgaggcgggcagatcatgaggtcaggagatcgagaccatcctggctaacatggtgaaaccccgcctctactaaaaatacacaaaattagccgggcgtggtggcgggcgcctgtagtcccagctgctcgggaggatgacgcaggagaatggcgtgaacccaggaggcggagcttgcagtgagctgagatcacgccactgcactccagcctgggcgactgagcaagactccgtctcaaacaaacaaacaaaaaaaagatttgactggatttgttcctgtggtaggcacttcattccaattttcttgcccactttttggttaatgacagactttcttccgctttacaaaataaaagcacacctctctgacctatcccactggtgcattgtagtcaagatacatttatgccaaataaaagtacaattcaaaatattagcgactgaaatccttctttactcaaggtaccatcaaatacccatccatctcataatagattcattttcaataactatccactgagtatgtttaataattatttatcaaaaggtacatatatttaggttatttggttattactaagtgtatttattattaatactttaaatactactcaatctagagaattttaaaaatacttagagccttgtagtcacaggaaattgtttttaaaaattgaatttaagtccacataaatataattttataaagaattatgatagagtggctaataaaactttatagcataaatatgtatcacatatttatcacattagaatacaattcattggggaagttgaaaaatatgatttaaataaaaaggaataatataaaacttctatttattaaatatgagctttttcatgtatttttaagtatatgatggtagacattatattgcaatggtatttggattccacgggatacattctaaactgtactataaacccttttaaaatgtcaatatttactgtatcccaagggcagaaaatagatgtcatctttaaaatgtgcaagcagatattcaattttctaaaatatttttattttttataaatacaatggtctgaatgccactataatagaggttctttgaagccctcttccttggcttggcaaagaggaaaagcactcttctcccctccctcataagaaagggaacagtaaaagtcatagaagttttctcatgtccaacaaattgttagtcctatttgaatgatctgttccaggaattctcattcaagaaactgttctcaagtttatccttttccttatatgggcaagttaggttggtgaacgatgaaaatctcatgaccatctactcccttttttggagtgtttttctggtaccaacttgctgctgtaggggtattttgaaggccttttttttttttttttttttttttaaagaagtcttgctctattccccatgccggagtgcagtggtgtgatcttggctcactgcaacctccgcctcctgggttcaagcaattctcatgcctcagcctcccaggtagctgggactacaggtgcgtgccaccatgcctggctaattttttctatttttagtagagatggggttttgctatattgcccaggctgatctcaaactcccaagctcaggcaatccacctgctttggcctcccaaagtcctagggttacagacgtgagctaccatgcctggctgaaagcctaatttttattgttagtacctcttaccataactcctgatacaacaagaaaggtcccattcactgtctttttctacgccttaggaaatgtgttcccatcttagttttgccttatctaacagagtcccagggaaattcactcaatttttcatttttagtgaagaagaaggtcaggttaaaaagggtaagtgagttaaacaatatcgtaaagccagtaagtgtcagcactgggattcaaacttagtcttttgtttctttccccttattattctacttcaactcagcaatggtttttggagttgagtagaaaaaacaaaaagtaagaggaagattatggtacccagtgttcataaagagaagcagatgcctaattccactaatagatgaaactatccacaaacttaaacaaacacgcttcaaggtgttatcaagccagaattatactcttgcccagaggcaacctaaactcaggagaaaaacattcaataaatctgtgttcagttgcatggtaaaagggaataatttgtctttttgtccagtaactgtcatccagtgtttttcaggacacattccactgatattttcatatccaatataaaacactgaaacttttttctaaaggtctcttccttgttccttacctcccgaacaccacttttaaaaaattttttttaaaaatgaaatcagataacaggtgaacttgagctagtacacatctatctaagggagttactatttgaatttgaattatccattctaaagtgaatttaatgacattaacctctgcaaagctaattttgtgaatgttgagtacactcctgactgattaattgggaatccattggtaagtctgactccttacccacgaaagcgtggaagcatggtaacatcagattttgattctcagtaatctgagtatattcttgagtctagagtcccaggcttctttgtttgaaaagcatcattggtttagaacatggaaaattcttattgaaatctcatttggttcaacttcagattttcagtatttagagaaatcattttctgtacagatcacgtttgtagagacctcattcatgtttcctttttttgttgttgctgttccttcggtgcctctttcctccaggagacattctcactattctgtttctcctcctctgaagactactgctgattagatgcttcacctctatggcacaaactaggcttctcttcttgttagtttgatttttactaaagatgaacttcaatggcctcttccgaaaacataagcactccctaagctggctcatctaagacctctcccttcccatcaccaccattcctccttcttcctttgactacttttgatcttccctttagctcccttaaatccttcagcatattcctcttcaaacccgtacctgctccatctctttgtccatccatgacagacctttctcttcctactccagtctctcaactctctatggtctctaaagcgttatgctccctgccactactgggggctctggaaaactcaaaccccagaagcaaccacctgaggttgaaaaagctaattggaaacagactggataccgtgtacgttcagatgggatttggagatacccagatggccactaggtatctcctcagtcatttactcaaattttagaacacagcctccataaattacatatcagggcaaaagaaaatcttaaaaggctcctccacaaatattgatgtaaacttttagccctcatattgagtaggtgaatttaacttgtattcataagctttgctagttggctatgaaatactggtatatgacaaacagttcacacttagctaattcctagttttctctataaaataagacttactaatggttaaaaatataatcaatatatgtaaataaaacttccagaaacattaggggtaaagggaaacaactttgtatgcaaaatatacaaggtatgttggatgtgtttttgttaaggaaaaagagaataactttgtcctaaattaaaatgactgtgaaaatgaggaagaggaaggtataggacaaaatctgaatgaacattggaaatggcagaagatttgtggaaggagagtcttatgttaatagccaatgctggctaaaacggaatggatttatgtgtatgtaaactcttacaaatgacccttagtatcaacagtgtattgatcaaaaatgagttgtagtttctttttgttaaaaaatgataaaatattcttggattattggtctgctcttttgaaataaaattgaatatacttaagtatgcaacatattttgatatatatatatatatatacgcacacacaaaattgcaaaacaattatttcggtcaaactaattaacattttcatcttttctattggtcttctcttaataagagattgcaaaatttgtttttttttttatattttgggtaatctgtataggaaacaaatattgtttcttatcagaataagtacctgtgttgattttgtatgtccttgaatttttttagaaagtagtgttttctctttggaaagaactaaaaacttttaccgtcatgtggccttctacatttatttttgaaatcttttattgtcatcttggttacataggtagccatgcattctttcatagtgagcaatgatcctattcagccaagtattcaaaccttttgtcattttacaacctttgatattttgcttttcccaggtcaattcttaaataaaattttttttaatctcagattggtttgaaaaatttcaaaggatttgttcctgcacccttgtaaaatgaaggatgttaaaaataactaggttcatttggtatgttgagttgcataaaaagctttgacaagaagagatgctgaaccttgactaggttatagttgtatgggtcaactattattagtataaatacttgaaaaattataataaatccttagaactttgttagtgctctaggtgctctaggtgtccatgacacatcctggtgctactttatccgataataatattatgtcatcagtcctaactccagttgttattttaaaatgtggcatggcaccagggaaaaaaaaaatttcttgtcgaatgaatcagatctttaattatggccattttaagtcttttgtcgttcacagatagtttttggtttatgctgatgcttccctgagtgctcttacaatcagttagaggtcagaatgcatcatcttcagtaaaacaggaccatctttgagacccataggaagtactacgacaggtactctgggacacagacttctgatgccattgcttaaataacttcgagattataccattggacaaagtcaggatttatgaaactctgtgaagaagctgatgagttcatgaaactactaactcaagatcaagcaagacaagaattaactacatgggcctgaatgaactgataaaagatttgattatggcttttgtttaaaatattcctcatgttttaatgttctgtttgctaaatacaagaaacgcctttcctttttctcttaagttatctataactcatgagaatttagagtatgcttttgtaaacagaatgaaacattaatctttttatccctgcctgatccctgtaaaattcagaaattcttaccgagtattcttattttcatggcaatataattatttgcataggctcaataaatatatttaggtaacaagacataattgaaaaaaatatataaccaaggctttgactggaatgtcatatttgagaattaagtgcatagagtcagatgtgaccagttttaaggagctactcttgactatatggagctaatataagccccttttgggaaaactgtcccggtacctggcttacagaattcccaatcttacaactgagtaaggaaggtctattcttaggagacccaggaaaccaagggtattttaggaacctggaaaacagaacacttcagctgaatctataggtattttacttcaggtaaaatctgatgtcaagttcttgacttgccttcctaaactttggagacttttaaaaaatcaaatctgaggtttcatattttttaaactactttattgaggtatgattgacaaacagaaagctgtacatatttaatgcatagaacttgatgagtttggagataaagtatatatacaaaaccaataccacaatctatgccataaacctatgcgttacctccaaaagtttcctctcaccttatgtaccactgctcctaaaagagagtagtagtattttgtggtaagaacacttaaactctgccctcagcaaatttctaattgtacagtacagtatcgttaactataggcactatgctgtacagtatatctctgaaacttattcagcttgtgattcttcatgaaaacttccagctaatcacacttaaaatagcctatttggtaaattaccatttttgctacccctatataaataaataggccagtcttattttataaacaaggaaagtcttactttgattaacactgatcaaaagggtgatggtagagatagagtttcagtaacccttggggttatcagattctagtcctgttcattgtctttgatctattttgcatttctttgtaaacgacatgatttttttttttttttttttacctacctgtaaattgatctggatcctgctgtcttacacattttgtccgtccttaccaattttcagtttatttcctttacaatctggctgcgattctccaaattaacatttcaaatttttctcccaccatcctgacttggtgacactgagaactaaaacgtgactgcccatattattactgagataaggactctcttctctaggttgtcttatagctgccatttccccacaatatctaaagaagccctgcaagcagaagctggatgacttgctataaactacaaaggactcaccaccacagcaaattatgtatagacaactttcatgcctggagctgctgctttgtaggccatgcaaaaagttcagtaaactccaacctcttccgtgccatgctccaagaaatccatcggattgctactgccatcctcactctaccatctgagaatgcctacagcccagcttctaggaatctttttgacttgctgccctctggactcaaaaactgagtttgcagtctgcttcaaccattaatcttcgtcttccttctaactttcatggaaatctccttcatgaaatgtctgattactaccaagtgtcagagttcgttcagctagtccttcaacaacagaaacctgctgaaatgaactagatgaactggcgttcctaagtttttcaatgggaaaactggtttcccttgaacaaaatggagggttgacaaagaaagctttaaaaataccctgagtttgactacatttgagacagatttcttcctgactttagacctgaccttccttttcttagagcatttactctagaaaactttatatattatttctctacttttttgagacaaaaatattctcctagcctcttgccacttttatacctcaggaataaactttctcaaggacttgggagctagcactttgatatagaatcatcaaaaaagatagtgccccaatctgctagtcttctgttgggaggataggaatctaactttgataagtgccaatcagcaaacacagatggcctaaataagcacattgactaacctccctcctgatatctagtactttctcactaactcatctcagcacttagaggctctcctgccttttatttcagcagaattgagttcaatctgtctcctctattgcaaaagttttgaacacagtctttcttgtctgttgtctagtgctatttttctttgacaacactcacagcaatgtgaacacacacagtgttcagtgactttaatggtcagtcactacaattgagtcctttggtagtttttagtgtggatttgacattatgggcaattatgctccttatactgcaaggaagagccagcagagccacatgtcatgtttatttataaaccacagaaggaaagtgattcttgaggggaggaaaaaaccccctccctgtgattaagatgaaagtatttcagtcactaagccttaacataaaattatgtgtcccgccacacctcatattttaataaaaagtttggaaagcagtagtcagtcttatgtcagataaatagtatacctctagctcattattgaaagcattcattaaaggttaaaaacataagaccctttatagaaattctaaactggtcccgggatcttagcattcaattatcatttctgaaatctgaaatcaacatattttatgtctaaattgagagtatatttgaaaatcaaaattcaaaggcatgccttctagtgggctgactgatgggaaagggctgtgattacgcctaattttcaccctctacatcacgatctcattgattatgtttctcagcttgctaagggttctgtgaggtgattttcaagatgaatattgctatttgcaggatttcctgaataggaatatttcgggagtaaattgcacaaaccaagcaatgtgcagtcaattttcactccagcataaacaatgtattagaacacagcccttaaagcttttttttatctgggtttcactacacagctagctgcatttcatcaataagagtgaagtaccaagcagacaaaactgaggctcacagagagagggtattacatatttttctaacaggtgtgctcagagtttgactagagaaaacaaactacccgaatggcaaggcctcagaccctttgtttccgaggcagctatggccaccatggccagacaaggcaagtttctttacatttaggatttggagctaggggcgtggctgttcgtatatctacttcctttgcattaactctttcttaagattttagtaaaggtgtttttttttttttaccttgtgttaaaaaaaagggcatgtgctcaaaactccttaaaaattttatttttggtgttcagtagtttgaaactaagtaaagcaaagtctagtgtcccatctttctttaatggaaaaatagtttaattcctttaagcagaggaatacagcaggctgtaaggactaatatcctatatcttaaatcagaaaaactgtgcaatcttaataaatcatttattagtgaaaggaatggaagctagacaaagagggataaaaaacaaggtaaattattattcacacaggtcaccatttcctaattataagctgggggtttgagaatttttgggagaaactctcaagtcatcaaatctatgattttatgtttcccctccccccaccttgaacacagccacaagcagaagaaaaaggctaaaagagtatttttgaagtctgcactccagagataagaaactcggaatgtgctcagaggactgaagccaaggagttttctgccaggaaaaaagcagctccctctcccctcagtgatttaaaacaagctgcaggaggcaaatatcatgactctcagaaactacacacagcagtgagtggtgacttgtagctttgataaagaaaagtgattaacacagccgagtatggctttcacttcaaactgcagggacccatttggcagagccctatgggccatagacaatcgaagacacaatgcaggttttcattatttgaaaaccattccggggggcacagactgggacaaaagtcattttgattgagtaaacaggatctatttgtaccaagggattcaaaaaaaaatcttttcttaaatgtgttccaggaagagagatagctagcattgagtattttttaaactattataataaagaggcacattttaaccaaagattgcatttaaaagagtagaatgtgcttttaccgtgagctacaaaaagctatttctggttgggaggaaagactttatgacctttcctcttcgcaatattacgccagttactttttaagaatatactggatataagataattgagaatttggctaaggttattgtgtattgggccaagtaactgtactttcttgttggggttgtttattgagcagtgaaaaatcagtattcatgagatgtaattgtactggtgaataggagctagtcaaacacctctgagtacaatatgtactagctaagtggagaaatggtcaggatcctagaactgatggcttccctgagacgatgatgtgttttgtacgcacccagtcttgccccttgtgatcatgtatgactaaaattcagggtgatgggacatcagaagccacgtcttggtatcaagacttccactgtgcctttaatgtgcaggctgttgttacccatcctgtataatttcttaaagctaactaaatttgttactgggtaaagcctattatgtctcgtaaatttaatcatcagactgaacccaagactgtgccactggctgagcaggctgagttttgtgctagtgaaatgatgtctacttgtgacttccacagtgccatctgctcttgaggagtagctatcagaatggtagacataagtgtcaggaggaagtaaggtaaacatagtcgagaacattttgctaatctaactcattttagttgtagcaaacttccctctatctccttgttactcatgcccatcttcccgaaacttttacttcctcttcactagaatattctcaaacttccttttccctttgctctcagttccagcaaaacaacagctaaatggagattaaaatgttaggtttttacaatactggacagtaaataaatttaacaattaaagtcaattaaataaaagaaaaaactactcaaaaatgttacttatcctttttactctgaagttgcccaacaatacattcattaatagattgtaatttcaacgattcggtttatttgattggctacttaaagattttggcaaataaggagacgcaaaacggggcagcatattgaaagaatctttggaatagattccttgaaagggagaaaagaagatcaatcagcatttacaaggacactagaagaaggagatagtggtgttcaattggcaggattgtctgaagccttacgcttacctgcagtatctcattcgtattctgggtgtcttggtactgtctttattcattgacttaaaaacactcacaagtaagcatcatttactggatcctaggctgagtgtgtatgatatgagtggagaagcagagataaataagagaatgccctctgcactcaaagaacagtgcagatgtgtaatgaaatactcaggtgtataaaatttaagtgtaaatcaacatatgaacaatgggagatgaataaaaaggtttataagaaatcctaacagggattctaactctacttggggtacggaagaaaacttggaagacgcaatgactttgaattcattcttaaagaatggaagaaaattcattatatcaaaataaactgaaagaagtcatttaaagaagagagaaaaccaagatcacaggtatgacatgaaattacatggatggaaaggtaccaggtaatttgatgtggccagactatacggggagattgctggcagaatgagaagatagaaaggtaaagtgtagtcagtctgagagggctttacaatgtctacaaaagagcccagacattatattttaggaacctaatctcataaacaacttcaattttggataaggaatctatgaatatgtattaagcacaattaaaacagggatagaaaatgaatcacagtaacaaatatgatgcaggcattctagtaacataagtttaatgaagaccttatttctagtaaatgctgaggaaaaagcaacatattctagtaaaataataataattattatcattatgacaacaatgatgatgatgacaaagattccctgcttgactaaactttagtcaggcttctgaaccttcgcctgggctcatctttgcactcccctgtaaaatccaggttcagcaaagaagcctgtcagttttacaagaaccctttatccttggtacctgatcaccctcagtattctccaccattccccaagggttgtctgataagataaccctggcctatcttcagcaagaatcctgtgaggttggtttagccagaatcccacttacccctgatgtttcctcttaataattttccatctactgactcctacactgctccttggctataaattcctacttccactgtgctgtatttagagttgagcccaatctctctctatccaacctcctgtaatactccattgcagtggtccctgtgcctattgtggttatcctgaataaagtcttccttaccacactttaacaagtaatattttgtctttaataatgataccaaatgagaaaattcagtgatattgccatttttcttaaaaaagacaaaaatatttaaagcaaaaagttccctaccttaacgtcaaatggtccttcttggtttggttggttataaatttccaactgattcctaataggagataaccacagcagcagatgatttaactgctcttcaaggtcttcaagctttttttcaagctgcccaaggtcttttatttgagcttcaatttctccttgtttctcaggtaaagctctggaaacctgaaaggaaaatacattttaaaaaggtaaataattctcaaggcataagccaaaatgtttaaaaatatattttcaaaagttatttatcatgaaatattacagaatcttactgatttgtgttattttagcagcataatattgattatttacatatattacatgttgggatttaaccaatgtattcaaaattattcattaacctgctacaaaaattctttgctttaaagaaactaatacctttttggaatttcaaaacacacaccttacacaaaggcatagccaactgcaactgataaagtaaagaaatacatctttcatttattcactcagttactaaatatactggtgtgttgtgtattatatgccatacgcgcttcctttgcagttataaaaatgaataagccaagttattcagcattagcaccagatatataacacaggtcttctaaatcccaaatgagtgatttttattcaatgcgcatcctaaaattaaaaccaaaccaactataattttgtttgtatagcaatcatttcttctactatacttgcttctagctttcttttatgtcatggaagattgtaaaaggaagtcccttcatgtacaaggaaaattggtaagttatgcgtttttgtgagctatagtttgtgagtcctagtaaacagaagcaggtggttgagatgagaagtaaaaagaacatttggattagagtagactgtaacagaatgattataggttatttttattaagagatcagtatatgccaaccatcatccttggaagtttcacatttgtagacttccttaatccatccaacaatgctacgacatagatattattatgatcccactatcacacatgggtgatgacgttggggttgaaaaaaacattaaataggttaggaagcagcatgacatggtattaagcattgtgaggtctagagttaggccacttggatttcaattctggttctagttcttgcctaacattttagccaagttttctctaactctcaatgcctcctctgtagattggggacaatgatagcacctgcttcataggattactgttaggactcagtaacgtcatccctgaacataccttagagcaatactctgcatgataatgaatgacaataaagttattaagtagcagtgattattgctcaagcttacatgtaaataaagagccaggataggctgagcactgtagctcttgcctgtaatcccagcactttgggaggctgaggcaggaggattgcttgagcccaggagttcgaggccagcctggacaacatagcaacactcccatctctacaaaaaaaaaacaaaaaaaacaaaaaacaaaacaaaacaaaacaaaaaaacagagccagaataaacaagagtaaagctattttcttcagaatatcaagagttaaaactggcatcccagaataaagaatttaaacttgtaatgatagctctttacgagactattaacaataccactgtaatacaaaatattacactgcaatatgaataaaattttataatatacatctgttccataataatatattatgaataataatagagaagattttaaaaataaactagataatataccagtgtgtcacataaacaatgtcacatgctttggaacaattgttttagatacttttaaaataagtcactaatgaacagtacattgtttaattggatgcaagagttaggagatgaaaaagagaaagttgtcgagaaaaaaatcaattaatgtacagaaaaatgaattttaaacaagattgtatacgtaaacaatatgtacagtgaaacgtcttgtaaatgcatgtatatatgttgtgaaaaattcatgagactgtataagcaaaggattaacatccagcctgggctgttgcaggtcagtctgggactgaccctaggctcccacagcactgtttccttggaaacactaactttaagatgaatgggaaatgttgggcctggctttgtcgtgtggaactgcacctcatcgcaggagctgtcagttggaatacagtccttggatccacgtgactacaatggtgtaaaagactgatgggaaatacaggtggtggctcctgttgaaggtgacctgcacacttcttgcctctcattcctggcagcctttccctgtgtgggtgagagttgggcaaaagaagcattgtgtttcagatagcacagaatgtccatgaatcatgaattgagatattgttctctttgcttgatttgtgttttgtgagttcacatccataactacacctgtggtgctgaactcttgtgtgtgtgtgtgtgtgtgtgtgtgtgcacgcacgcgcgcacacaggtatgtgtgatgtaggtgatgttacaaatatactcctacgtctgtaatacatgatctaatgatgtcctcaacttatttttcaagcattttaaaggaggtaactaaacattttatttttattggatcattttctactcacaagtagatgtaaaaagcgttttacagcttcaactaacaacatctaaatgcctctagactctgaagctactgagataatagccatcatattttcctaaaatctctaaaactgagcgatgaactcctttttatctgatcatgaaattgttcacgtttcatttaggcttcatatataagcacagaaatctgtataacatttaactaagactgctggtttccttatcatcctcccatactatcccttccttgtaatagaggtaaaacaattcctgacagaaaacagtgtaatgggtcagatttgactaatatctggaataatgaaatgatagcttatcatgagacgaaattttcagcttaattatgatgttgctttaggtttatcctctcagatcttgtctttcccaccatcataacatttacctcatgctatttaactttctatttacattgctccttctcactgacctttgatttctgggtcaaacaagctctgttcctaaatatgatggaccttcaccaaaagtttgttaaaaacaatttccaaattcaggattattattttttcaatgtaagaagcagtatatgtctatagtagtcaaccacaaaaaaatgtaaattgtatcctcaagttaaataactttaattaacagacaaaaatatcagtaaactggactatataaaaaatcaaaagcttctgcacgaccaaaagagccataggcaaaatcaaaaacaaatgaacaattatgaaaaataaatgcttgtgactcatgtctaagggactaattttcctaacacatgaaagaccttctgcaaagtaataagaaaaaggccaacaacccaaaagaaaattggacaaaagataaggacagttcacagaaaagaaaatacaaaggattttaaaagcatgaacagaagcttagccttggtaataatgagagaaatgaaaattagagcttcatctattgcactggcaaaaattcaagtctgcaggtacactatgctgccaaggctgtgggaaaatgcagactcttctacgtggctggtgggaagtatacatttgtgtacctcttgtggaaggcagtttggccatatctataaaaagcatgtaaactttgacctggaaattttattcccaggaatttattttgtagatttgtttctagaattaaggttaatgtgcagtgagggtagagcagatgatgggtagggtgagatattttttactgtaccttttatattttgaacaatgtaaatgcattactgtattagtctgctctcacactgttaacaaagacatatctgagactgggtgatttataaaggaaagaggtttaatggactcaccattctacatggcgggggggggcctcacaatcatggcagaaggcaaaggagaagcaaaaacacattctacatggcagcagggaagagagcttgctcaggggaactcacatttataaaactatcagatcttgtgaaacttactgattatcaggagaacagtatgggggatcctcttccatgattcaattatctgcacctggctccacccttgacatgtggggattaccataattcaaggtgagatttgggtggggacacagccaaaccatgtcaattacttttgtaaaaaattatttaataaggaaaactactgtaccagctcatcttcctaccacaaaatgttgttgagaaattacactttgcatattttaataatgaatcattattattctggtataacatatctaaagccatcagtgaaaaatgctctgaagagttttctttggcaatatcacttaatggttgggtggaaatcaagaacttttaacacatattttttttgtgctcttctgcactttaaaacagtttccaggaatcgagagtattccaaatacttcacggaaaaatataacaggtgtgagtaatgtataacgtggaaaaagattaaggtttgtatcagattctatgtgttttaaattaatttacatttatatttactattttgcattcacatcaaagtatagacacaaacacctgaccggtaaaatacatcatttttctaataatccttttatgtattataaaaccatgctcttcatataacatgttccctgtggtgaaagaaaacaaacacattcaattcccttatgtgttaatttagtatctaagcacatcttgacctaatttcacacaagattactttccttattctttcaatctctgaatgttaatttcaaatgtatatgttttaatattaagataagcaaaagtgtctgttttagaaataaacatattaagatggatttcataacacaaaacattttagaaaaattaaagtgttaagcataaaaatagtaagaagaactggaataaaatattggcgtggggaagccttttagaagcaaaaaaagaatataaaaagattgaatataatatgcgtattcacttataaattaaagccactaatcaaaattaaaacaaatgacaactgggaatatttgcagcatatatcagacacagggtaataattttagcatataaaaaaatcttttaatgagtaaaaaaaggaaaaatctactggaaaactggataaagaacataaaaagaaattgacaaaaatgtaaacagccaataaacaagaaaaaatccagacagttagtaatcaatgaaatgcaaaggaaaacagcaatgttatactattatttatctattatattagtttctgtaaaaggtctttgtcaaagttctggaaaacaagcaattttatgatcttccttggagccctattatacagtcattcaccacatttcagtcaacagactgactgtgatcctatgagattacaatggagctgaaaaattcctattacctagtgatgtcacagtgcaatgaattactctcacgtttgtggtgatgctggtgtaagcaaacctactgcactgccagttatataaaaatacagcacagacaagtatgtacagtatgcaatacttgataatgataataaacaactgttattggtttatgtatttactatattcttaattagttcaaaagaaggcattgttatcctatgagatgatagtttcatgaatgtttcattgcccatgaagaccttccagtgggggacagcatgtggaagtggaagacagtgatattgatgatcctgacccatgtaggcctaggctcatgtgcgtgtttgtgttttactttttaacagaaaagcttaaacagcaaaaatattaaaaataagaaagctgctacaataaggatataaaatatttttgtacgggtgttcaacgtgttcatgttttaagctaagtgttattacagagtcaaaaacttaaaaaaaaagtttataaagtaaaaaagttactataagctaaggttaacttatcattaatgaaaataaatgggccaggcgcggtggctcacgcctgtaatcccagcactttgggaggccgaggcgggtggatcacaaggtcaggagatcgggaccatcctggctaacacggtgaaaccccatctctactaaaaatacaaaaaaaaaaaaaaaagataaaaatgtgtcctcataaatttagtgcagcctaactatacagtgtttgtaaactgtatggtaccgtacaataatgtcttagatttcacatttgctcaccactaccactcactcaccgactcacccagagcaactttgagtcctgcaagctccattcatggtaaataccgtatgcagctgtactattttttatcatttgtatactgtatttttacggtacattttctgtgtctagatacacaaatattgttgtgtgacaattgactacagtattcagtaaagtcacatgcagtacaggtttgtagcctaggagcaatatgctgtaccatatagcctggatgtgcagtaggctataccatctatctttgtgtaagtacactctatgattatacaacaacaaaatcacctaatgacacatttttcagaacatatctcatttgttaagaaatgcatgactatatatgttgctagtaatttggtaattcagaccgaaaagttaagcttctaccctggaaactacaaacactactgagacagtgaagaaaatgtaaacaaatagaggactaccttcttcatgaattagaaagtccaatactgtaaagatatctgccctctcttcaaataatctataaattcaatgcaatctcaatcaaaattgcagcaaccatttcttagtagaaattgacatgccaatcctaagatttatatgtaagtgcaaagggctaagaatatccaaggcaactttgaagaacgacgaagtttaagaatgtttgccaccagacatgaatatttattataattaagcctgtgtgggattgaagtgagaacaaatcatctatatagcgtttcctaatttatacgatggtgtcacttaagttggaaaaggatgatcttttcagtaaatagcaccaagttaactgattagtcatttgaaaaacatgaaccttgactctccacatcatacacaaaacataaattctagattgtttgcagacctcaatgtaaaaggcaaaaaaataaagttttcaaaagaaaatatagaaaaaaatctcaacaattttaggttaatgtattattttttaaacaagacataaaaagcattagccataaaggaaaagactgataaatcaaactccatttatcaggaaagattgttaagagaaaaaaataaagcaaagtttaggttggaaaaagatattcgcaatgcatagatctgacaaaggacttgtatccaaataacttctacatcagtaagaaaaagacaactattatttttaatgggcaaaagatttgcataatgacttcacataagaggatataaaaatggcactaatcgtcaggtgattgcaaattaaaacacaatgaaataccatttcacattcacctaaatggttaaaaggataaaggttgaaaatacatactcttgatgaatatgtggatcaactagaagtcttatatactgctggtgaaaatgaactgaaatgaccacactgaaaaactgttttttggtgattccaaagccaaatgtacacatcttatgacctagccattgtacttccacgtatattaaaaataaatatatacatatatgcagcaaaggacaggaacatcacaccagcatttttcctaatagccccataatagacacagcccaatgtccattgattagcagaatggataaactgtggcatattcacacaatagaataccatacatagaaaaactaaactaactatggcacaggcaatagcatagaataatatcacaaaaataatgttgagcaggacatgtcaaatacaagggcatatactggatgattctgtttatagtaatttcaaagtcaaaactaatctaggtgttagaagtcaaaagagtgcttatctttgggagagggtggtggcaggggagaggctcataactgggagggaacatgagaggggctcctgaggtaatgttctaattcttgaacttggtggtagtagcatggatacactaagttttttttaaaaatccctgaatttctattcttatgatttgtgtacttttctatgtgtctttatacttcagtttagaaaatttgataaaactactttaaaagccttaagattactcattcccttcaactccaaaatgctacttctatgaattttcctaggggaatatcagagataaacacagagacctatgacaagaatgttcaattatgtcactctggcgaaaaagtgaaacgaaatctccccaaatagaataaactgcttttacataatgaaatatgttgcgtccattaaagtaaatattatgaaaaacatcctattacactgaaaaatattaatgacatattaaaaatatattaaaaataaattatggttttgattttgtatgcatattttacatatcagtatcgacacacagcaaaggacatgaatagatatttctctaaagcaaacatacaaatggctaacaagcatatgaaaaaaaaaaatgatcaacctcactaatcagcagggaaatgcaaatcaaagccaaaataagatatcatcttatacctgttagaatgactattatcaaaaagacaaaagaaaagtgttggccagaatgtggagaaaagagaacccttgtacaatgttgatgggaatgtaaattagtataattattgtggaaaacagtatggaagatccacaaaacattaaaaatagaactaccatatgatttagcaatcttatctctgggcatatatccaaaagaactgaaatcagtattttgaagagatatctgccctctcatgtttactgcggcactatttgcaatagccaagatatggaatcaacctaaatgtccatcaataaatgaacggttaaagaaattgcggtatataaacacaatggaactctattcagccttaggaaagaaagaaatcctgtcatttgcaacaacacggattgaactggaagacatgatgtcaagtgaaataagctaggcaaagaaaggcaaatactgtatgatttcacttatatgtgaaatctaaaaatgtcaaactcagagaaacagagaaaaatggtggttattagatcctgggggtggggtgatttgggagatattgatgaaaagatacacaatttcagtttgacaggaggaataaatcctagttatctgttgtaactcagggtgactactgttagtaacaataacgtatacttggaaattactaaaagtagattttaagtgttcttaccacaaaaaataataagtatgtaaggtaatgaatatgttctatagcttgatttagtcattccgcaatgtttatttcacaatatgtgatatttcacaatatcacattgtacaccatgacaataatacaatttttatttgtcaattttttagaaaatttaaaaatttacacatagattttcatatttgtgaatgattagaaatacatgcacactttagtaaccttgaaaggagtattataaattatacatgattttaatgtaatttttaatatttttgtcccttttcaaagttaccactcagaaagaatattatatgttttatatgttaaatagaaataaataataagtagtactggtttggtggctattcctctgaaatattagcaacaataaaattactattataacttaggtttacaacatatttcaggtacttcatgatggattttacttatattcactttcttattctacccatgatcctatgaagtacataacattttctaaaattatcaagtgaggatattaaggatcaacaatataaataatattcataaggttactagtaagtaacaaagatggcactaaatatccaggttttactgacttcatattctactctttccttccctcttccctcccaaaacatactttccagtatctttcaaaattgacatcatctgggccgggcgcggtggctcacgcctgtaatcccagcactttggggaggccgaggcgggcggatcataaggtcaggagatcgagaccatcctggctaacacggtgaaaccccgtctctactaaaaatacaaaaaattagccgggcatggtggtgggcacctgtagtcccagctactctggaggctgaggcaggagaatggtgtgaacttaggaggtggagtttgcagtgagccgagatcgcgccactgcactcctgcctgggcgacagagcgagactccgtctcacaaaaaaaaaaaaaaaaaaaaaaaaaagaaaaaaaaagacatcatttgataaatggatctatttaaacttatgcttttcaatagttatttgtgtgagtacaatctatacccttaatacttagtatcattaaagcaatatacattgagaagtcaacttcaataagaaataatataaatgaaatgcatgcaagtaaacatattttgaaaatgaatattaatatgaatattttgaaaattaaaacattactgtttgccatttgttaattttatggggactagaagaacagttagaatgcttatcaaatgcatttttggattatgattaatccaaaatcatgtttaaattatcatgatataattgtgataagcatcttctctattttggttggcttgtcatttattttataatagaagcatagataacataagttgttataaagattaaaaataataatagggaattttcaattccaataagtaataatttacatgatattttagcattattttcaaaaaatttaatgtaaatgctgaattcggaaacttctgtacttaaaaaataaagacttgattgaattttaacttaattttaaaatcctatctcacacaattcctaactaaataccagatgaatgaaatgttacatgtaaaaaaattgaactataaaagtaatgaaaatatgggaggctattcttataattttaatttaaaagccataaagtaatgacttacattcatagcagtataaaatttctttacataaaaaatcaaacaagccaaagaaaaaggcaaaaacaattcatctttttgacactcttaagataaaaacattctcacaaatcagtagaaaaaaagacaaatactcaattaaaaaggataatgaggaatagaccatttaggaaagaactataactgacctatgtataggcctattaaaattgtttgacttcactaggaaaattcaaacagggaggtgtaatattgcacctattgatttaacaaagatttaaaacactatcttgcactgcaatacaatagtctcatacaacagaaattgtgtggtgaattgggtcttctcattactgatagcaagcaaataaaatgaaatatctctgggagtggggttgggtgtcgatgaggtaggtttttgtagttcatatctaaagtctaaaacattttagtgcacttagaccagagattttacttttaaaatttcaaaaaaattttctgcaatgaatatgtgcttcttttaaaaaagaaaatcattattttaaatataggtacacatgtatacttctatagaaagaggtttatgtatgtagtgcctaaaatgtgcccaacatatctatcaacaacatctaataacaactctataatacaggtagtattattgttcccagtgtacgcatgtgacttgtacaaggtcagatagctgtgaaatggtaaccaagctaggatttgaacccaagaagttaggctttgaagcctatcctgttaaccactgtactattttacctctcattccctttagctatatgactttgagaaaatatactatatgagtgcaaaagaaggtttgctttttgtttacacaatttcacaaaataaattcctttaggtactgactggagcttactacaatttcttcataactttgaaagtaagtgggatgatagagccctattttccttgccactatcaaattcagttttcaaaactgccactcattgattctcttgcttaaaattgtgtgactgatttccaatagcctccaacttctttagcctgcctttatctaaaaaatggttcttaacaatctgacgctatcttccattcttcaaatcttcctaataacaaagcacttcttttggtctgttcctctgacattgtgtactctgccattaaaatgtcttcttttccctcaataaaatatctcttttccttatcgacacatataaaactcttcccaatccttcatgttttgggtaataaaagttccacctcctcagagaagattgcttaatccctctggaaggaaataatgattctatctaataaactctagcattaattacctgggctacttcattagacaccgtcagttattacttttttctttattttactgttctcttccaacttatgtcttctttcttctcttgtctctccccaaaagctagaatactcacacatacacacagccacaattgaattttacatctttatataccgttagtaacttttcttacatgatatagcatttgttaaatgaacaatcatacaaaacaatcaatcattcgctaataaaacagaaaagagaaggtaaatctcctaaaaacgcttatgttcttgtacactttgaaaacgcttatgtccttatacatgacatttccaactctgtttcccattttaggctatgtgtgaatatccaagttcactagcacagtcagaacaggtgttacttggcggctggactagtgaaatttgatgtgaggaatacagagtagaagagggtagaccctcttgagggtcagtcaagaggactaaggaataaaattcttgatatgttttctgttagttagcttgatgtcatggattctggggctggagacagggctaggtattaattaattgcaggactagtggtaatatccgtgtaattaattcaatcaatatttacctagtagctattttgttccagccgctgccctgtattgcttctgtagttgactgaagttggccattgtatggctacgtgtaagtctccaatgccaatatccctctaccttgaaaatagctaaataacagcgcactctgaatgcattttaggcaaatattctgttgcccccaaccaaaaatcacctcccccaaattagtaataccaattaaataattcatgtaaaccattatcttcttttggataaaatgcacgtagtatgaaatatttggagagttcattttgcctcacacatttcttaacaacaataaattaatgtcactggagaactagacttagcaaagatatcttcccaggcacaaaactcgattatttttacaactggtctcgtggtaaaatatccctcactaggaggtcatttattttctttccctctggaaatttaataaaataatgatgaatatatgactgaaaaatacattgtggttatatgccaccagatattttaaaactataaatccatatacaatgtaaaagtgactaattacaaatcatttttatgacattcagcccccagtggcatagctctcggaatattactttaaaagtaagtggatttcctttttaaagcatgtggattttacttacgatgcttatacatctatatttcctacattgtttccagttttaagtatctgataacagtgaagtcccctgtgtcaaatcacagtgtatgttagttttattgcataaccacttcattaccacacatggattttgttatttttctcaagacctcaaacatataatacattacgaggtaaatgaacatttctagcaagatttcaaagtcagtaaaatttgatgtacaataaataggttggcagtccttggagaactctgcccttattaccacactaaaaccatattgacttttcagtaaactttggtgttcatgagcagcactgttattcattaatttatttgtttgcagtataagcatctaactccatggtcaaagaatacttaataatatacgtgagtacatggataatattttctgactgttcaccttgatctaaacctaccctaaagttaggtaacaagccctttaatggctcctggaggcattagacaaatgaagtgaataggtgacattgatttgctcaaacctcaatagttctaaaatggattttatagggatttatacccatctaactatccacctacccacaaactcttcactaaataatgtgattttggtcacatactgtttaaaccctgaggacaataaaatttaaagaagttaaatgtaatttaatctctctctctgtctctctctctctctctctctctctctcacacacacacacacacacacacacacacacacacgcacaccacagaatgtgttgttacaaattaaccccgtatttttctccctctctccctccctcccagccgtactctaaacaaaggctctacaaagtagcactaaacaagggctactttattcccacactctccaatcagaaatctttgatcttatttgcttgaaggaccttagcatcagcctggctgatacagaaaaatgtcccttggattcgtaggaaatatcatttttaatatttttgtttgctcattttgttcatttgtttgataaaaattcaaggaaaactaagtcatgatctgtacagttttacccaagcaacaagaaccataacaaataacaataacttgatatttatttaggccctgaggtgtctgttaaaatttggtttcttaatagaatttaaaaaaaaaaaacagtctccttctttttacttttatataaatcactgtacttcagaatatggatttcagggggggaaagaaagggaaaactacaccacataatcacgtatcctcaaattcagaagtttcatttaagaaacaatttagctggggatggtggtgcctgcctataatcctagcactttgggaggccgaggaaggaggactgcttgagcccaggagttggataccagcctgggaggcaacatagtgagattgttgtttcaaaaaaaacaaaacaaaaaaaaaaagaagaagaaagaaagaaagaaaaaagaaaaacaaagcaatttatcaaaatgtaactttaaatttaaatgtattaaacttaaatacaatttaaatatcagttccttagttgcacttaccacatttccaatgctcaaaacccacattgtattagacagggcagagaaagaccatactcattataaaaaagttatcttgaacagtgttacaagccgtactacactatttgcttatgcatctaaaaaacttgccaatcttcatgattttttgaaagcgtaacattttagaaaataatcagtagtgttcaaatatatataccaatttgatagtttcaataatatgaccatgaattgctggttttaatttcaatattttctgtctagaaagcttgtttttctccaaaactcattctctaaaaaacaaaacaaaacaaaacaaaaatagaaaaccaccacactgaaaagaaatcctattcctttgccttcatctgaatggaatcattttattgtcatgtttaaacatataaatataaaaaaaattttctatcaaatggcatgacctacataactcacatttatcttttctatgtgtaatattcatattgttgcaatttgatgcattattgttatttatactatgaagcaaatgcatattgcttatccactcaatgaaacatggctaacaaagaagaaaatcagtatccctggaacttttaaccttaccaacaagtaaaataataatatcatatagaattgctactcctgggaatggtgatgcttagaaaggttttgaacacaacatcgggaagagttggcattggcatatgtgaagttgtagctttactagctgtgtgacggtatgaggaaagtgaatacaattcaaagatgggttggtctcttcctgctggccagaagagaagagagcaaagaaaaaaagagaatatggatataaatttgaaaaagaaaaatacttgatttctctggaaacaataaaaaaatcagggcaaaagtcaggtgccaaaatagttttatattctgcgaggattgttgccataaccccatttcaacaggagacttgggcagagggcagcaaactatggcttatgggtcacattcagccaccatatgtctttgtacagtttgagaactaacaattgttttaacatttgaagaaactgaaaataattaataaatgggtgagacatgaatattatatgaaattcaaatttgtgtccccaagtaaattgtcacgggacacagccatgcccattcgtttatgtgtagttacgtattagggctgcttttgatccacaatagcggtgttaagtagtcgtggcagagacctattggcctgcaaagcctaaaacatttaccatctggaccgttatagaaagtttgctgacctctgctctaggtgttcaaggagttgtggcccaacctccagtccatctaagtcttggtcctgcctgtatttcagagccgctttaacgggtgagttggtgagtgcagtacagggcttcaatgtacgagaaataaaaaaacttttaaatgcagtatccattaatttacccaaattggaaaatggacaagacagcatcctttggtggaaatttttttaaatccacgaccctcctggtctgtttttgggacactttgtagccagtatgtacaaatgtctgatttagctgggccatccatctgggaccagctagctgaagcttgcaatcgcagttagctgaaatttgaaacttgaatatttcaagtggtagacatttagcaataacaaattatctacatcattatttgatatcttttaatttgcattccaagaagttgtgcgtttccaaagcagtgaaagaaaataaaacaaaaatttaaaaaatggaaacgatatgtcaacataaaagccagaaaaaaattaatttttaaaatactattataccctgtaaattacgtgtagccttgatgggcatagaacttcaccggttaatatggtagccactaaccacatgtagctattgagcacccagcccagaatatgcctatttggaatagacatatgctgtaaaatacatattggattccgaaggcatagtactgaaaaaaaaaaagaatccaaaatattttaattcatccatgcatcacttaatgacaggaatacattctgagagatgtgtcattaggtgattttatccttatgcaaacatcatagtgtgtacctacacaaacctaggtggtacatatagcctactacacacctaggctacatgatatagcctaatgctcctgggctgcaaatttgtgcagcacgtgactgtactgaatactacaggaaattctaacatagtggcaagtactcgtgcatctaaacatacctaaacatagaaaaaggtatggtaaacctactgtattataatcctattagatcaccagtgtatatatagtttatcatggaccaaaacctcattacacatagcatgactgtatttttgcactgattgcaacgtcaaaatgatacaattttagatacactgggttaaataaaacatataatccaaataaatttcacctgtttatttttactattttaatgtggccattaagattaaaataacatatgtggctcacattacgctctgtaataatgcaatagcagcttttattctatagtaggaatagcagaaaaatattaaatgaaagatcatccatagatgtcaaaagtcatgtgagttttagtatatcttctaagttgattattttaataaaaggtaagaggtaaagaggttttcttattaacataacatcaatttttcttgcccccactaaataaatgctgaacaaatattttaagcaagcgtatgaaggagcatcaaatagtagcttgtcttgaacaaggtgtccccagtgtgtttcctagactcattgaaaagaagcaaccttacgtatgttaatcccatgtggttaatttctggcctccatgtttaattgatctctcatactagggcctctagccaccgtcctccaaggttgtgcatgaaaccagaaccctacagttttgtctgaagcacactgcttgtcctacatttttggcccccaggctgcatatcacgcaaccctatttttcattaacttctggtctgagggggaaggtactgaaaaaaggaagagctgtacttgaataatgttactgtcacacaaaaaaaggggaaagggagggagggagggaaaagacctggcctccattcccgggtctcagatgaggatgcctggtggtagtttcccttgtaggagggataggcagggtaatcaagggaaggaaagagagagaggcatgtggcgaaaaagggaagtgagagttgagggattacactagtgctgcatgcaggggaagggacagtaactaacagaggtttggaagtcaggcaacctgacttctaataccacctctaccgctacttatagaatccgagggccttccctgagtatccttggaactgaaaaatgcagacatttgatcagattaattctgaggtcccttctagcttgactgttccacaaacattttgtctctggcagggaatggaggagtatacacagccctgaacgtgtcactgagcttcaagaagacaaagactgtgtctgcctgacacctggatgcctgtgaacacaaaagatcttctctgagggtttattgggagcttgtgacataggcctaaaatgtggaaaatcctgtgacaacaggataccctgtcaccctaagcagatgtaagcttaattttcttcacagcaagataatgagcaatagaatagaacctaacaaagcaattttggatgagggcttaacacaatcaactgccatggtgttccagccatttatttacaggatttaaacgtctttcctccaaagccgggactcctgccagataacctgtgtaatggacctagtgcaatgacctacaccaaatggctaacaattttgtccagcccatgggctttgcgagtggggctcatctcttggctctggctaagtatgcagctacattcccgatgatgtggcaacattttaggctctggtttccaggagagagctgagacacagctattctcaggccttgggaaccaccgctttgagaaacaagttaggaaaatgcagaggaccttacgtcccgggggaaactcacagaagttttggggcatctttataatatttgtcaatgaaagggaaaggaacattcctttgaaaggcaaacacagaacttgctctgttcccaacttatgcctccaaggctgtgtgaggagattcttctgaagtctacacatcgctgtccattagagcatctctattagacagacattttaatttcttcattgggatgaaactttttacacagtagatactgcgactttgtaatgtttgtatgaactgaagctggaattaaaacaacaaatctgaagccatggtctttttcatcacttttatataaattactcagagttccagattgcaattcatctatatatttttacaggtgaagcatgaatttaaaaaaaaatttaaaaagtggtttcactcatttaaaaaactgttgaattggttagttggttactggttaaaagaaaaattatttagggccttttatatgccaggcagtatgctaggtaaatcatccctcccttctatgaacacttattctggaagaaaaaaaatgtatttaaacacagaattcaattaccaagtgatgaatactctaataaagacagacacaatacactacaaagtcatggagtctggagggcctctgtctcctggagaaagaatggagagacaggaggcaggagagaaggatgatttcacagaggatatctcatttgaattttctgttaattaatgggtaaactatcgaaagctattctgcgcagcccattaaaaggtactctgttggctcaagcttgacagtgtgtgaggaagaagaaagagatcttatgactagggttgccttataaaatacaggataccatttacattttgtataagcaatcgatacttttcagtattttttgttgtagtatttgggacatagttatgcttagaattctggatgtttcatatttttatttgctaattcttgggatcctagttatgactggaatgtggaagaaaacaataccagctgaatatgatttgaagagttttgtgtgccatgacatggagttttgaacttattctacagggataaacacttttgaaaagagtttatacaaagttgactttagaaggattagagtcaaagggggacttgaaaccattaagaagtcaagccccagtaatggcatgaacagagctcattctgctttccaaatatctaatctgcagtagatacttagtggctggaatcacctctgacatggctgacctgtgacagctatttcatctgcacattgccaatatctctgtgcttaggagattctctaaagcgcggcataatttttcttggatttcccctttcctgtttcattaaccctattctttcactcttacatttgaggatgaacttctctgcttccaatttcttgtcttacattctgttcttgagtgtatttaaactaacactttatccttttccatttcttccaaaaagtaaggataaatggtccttgatttatttgcaagctacttctttccctgaaaaagtttgggtgatccttagcatcagggtttagtatgactaaaagaaaaatatgtattagttattgtacaagataacttgaatgatcttttaaattttacagttcatatgtgaaagaaacttggcagggtcttcctaaattggacaataaattgtaataatttatgtgacatcaccaataataagttgaaaatgtaaaataaacttttctaaactatcaatgatagaagtcaaattttaatcaacaatgctgggggaaagagtaaattattttctgatgctctcacatgaagaggtgctgaaagaggatgcatccagaaagatagaaaaaattatttcagacactgtatattctagtattgcagagatggttcattattaagaaaacattctgcttatttttttcaatttttgtgatgtatgtggttatctgtcatctttttaaaaacgtataatttgttatgatttcctttctttctataatcatgttcatacctaattttatatttgtcctgttatattctttgacttaaagaaaactgccaaattagaatgtgcttcaagtttcagaaaaccagatctacctctgcttattcttttacctttattgagtatagaaaaccatttcattcagtatcctaaaataactaatttggtataggcattgcaaatctcttcttttactttgaagaccccatcgtttctaacagatgtaaaaacaaaaagaaaacaaaaataaaaaatgattttatctgacttataagtagtacattaaaactagttgagtttttgatctaaaatttaaaaataattagccgagtttctgatagaacaacattttacaatttctttgcttttttcttttttttttcttttattattgtactttaagttttagggtacatgtgcacattgtgcaggttagttacatatgtatacatgtgccatgctggcgcgctgcacccactaacttgtcatctagcattgggtatatctcccaatgctatccctccccccttcccccaccccacaacagtccccagagtgtgatgttccccttcctgtgtccatgtgttctcattgttcaattcccacctatgagtgagaacatgcggtgtttggttttttgttcttgcgacagtttactgagaacgatgatttccaatttcacccatgtgcctacaaaggacatgaactcatccttttttatggctgcatagtattgcatggtgtatatgtgccacattttcttaatccagtctatcattgttggacatttgggttggttccaagtctttgctattgtgaatagcgccgcaataaacatacgtgtgcatgtgtctttatagcagcatgatttatagtcctttgggtatatacccagtaatgggatggctgggtcaaatggtatttctagttctagatccctgaggaatcgccacaccgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcgcccactttttgatggggttgtttgtttttttcttgtaaatttgttggagttcattgtagattctggatattagccctttatcagatgagtaggttgcgaaaattttctcccattttgtaggttgcctgttcactctgatggtagtttcttttgctgtgcagaagctccttagtttaattagatcccatttgtcaattttggcttttgttgccattggttttggtgttttagacatgaagtccttgcccatgcctatgtcctgaatggtaatgcctcaagagaataaaatgcctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggtcatactgcccaaggtaatttacagattcaatgccatccccatcaagctaccaatgcctttcttcacagaattggaaaaaactactttaaagttcatatggaaccaaaaaagagcccgcatcgccaagtcaatcctgagccaaaagaacaaagctggaggcatcacactacctgacttcaaactatactacaaggctacagtaaccaaaacagcatggtactggtaccaaaacagagatatagatcaatggaacagaacagagccctcagaagtaacgccgcatatctacaactatctgatctttgacaaacctgagaaaaacaagcaatggggaaaggattccctatttaataaacggtgctgggaaaattggctagccatacgtagaaagctgaaactggatcccttccttacaccttatacaaaaatcaattcaagatggattaaagacttaaacgttagacctaaaaccataaaaaccctagaagataacctaggcattacaatttcttttcttaaggaatgatggtttgagtaatcctttagggttttaccctttacatgccattaaattgtcataattaatcatcatgcaacaggttgtaacatgtaaagtgacaatttagaggctgatacagaagaatagcgaataacaggggtttagtttttatgcatcatttcttcaggaaaacacatcatgaggggaaatagctttgaataagttcagtgaaggttgccatttagttaattaacttaaccattttcattagcagactcagtattgactttagaatactgtctgcttaatttcttccaaacaatgaatatgtatgaaacaccaccaaaggtaaagtgaaaatgaagacaatataggtaaaatgtaaaaattaaattattaaaatatatcagaaaagtatgtggaatacatttataaacttatattcaattgcagtgtgctcctccaaacttttaagatatgaccttggcataggcacattatttcagctgcttagcacaggatttgtaataatctcaattttataagaaaatgcatttctaaattggttggagaaggctaaaacaatgcataaatccagtgcactgaatataattttctgcttcaactgacgatctagtcttttgaagaacaggcttttttttttttaaccatttttggccatattcattttctgcaacttcatgttggaataaataaaatcagcaggtgcctattgatttttggagggagaaatctcattcgtaagactgaaaaaaagtgaagtccatcataaccaactgatgaacaaatacgtgtgaaaattgaagaaaataataacgtagaaacaaagggtaaatatcgatacaactatttaatatgactgattttcaaatctggatttgttgtctctaggagttggaaggtgggaaggcctgcaaaattttttttattaatttaaaataggacgatatacattccatacagcgattatttattttcttaaccataacagtcttaactagagcacacagcagaatcaattgggtaggagtttttgttttattttgttttaatatgtatatccaagctccataccagagaatctaattccataagtttgtaatggagtcgcgatagctcaacctaatttttctatttataatatagaaatagatgcttagatcccagtggtacaaacatccctgctagagcccacacaaactgcaatgcctattagtagtaagaaaatgagactgcttctctttttaacattttgttctcattctcaatctgcatttacctcagatttactaagtctaaaactcaagtcaagtgtagtgcagtaaaacaagtaagttaagagctggaaggactcggtgtaacagtgtgcattatgacttatgtgcctttggattttagttttggggggaaccactttaagcccatttcttcttttgtagaacagagagttaattctcacagtatctatacttcctagttcctcttccttttctccatgtgtaatttactccacagtcttcttttattttgcatcactgatacggtttggctgtgtctccacccaaatctcatgttgaattcccatgtgttatgggagggacccagtgggaggtaatttaatcatgggggcaggtctttcctgtgctgttctagtgattgtgaataagtctcatgagatctgatggttttgaaaagcggagtttccctccaaaagctctctctttgactgctgcccatccacgtaagatgtgactcgttcctccttgcctggtgccatagttgtgaggtctccccagccaagtggaaccgtaagtccattaaacctctttcttttgtaaattgcccagtctcgggtatgtctttatccgcagtgtgaaaatggactaatacagtaatttggtaccagtagagtggggcactgctgaaaagacacccgaaaatgtggaagcgactttggaagtgcgtaacatgcagagtctggtacagtttggagggctcagaagaaaggaaaatgtgggacagtttggaacttcctaacctcttacatccagcctggccttttacattcccagagcaagaagtctgttcaagtccttattatctgggccaccggaaaaaatatatatctcaaaccagtttgtagacctccagtctctacctgctgtaattcaacccctgcattgccatcagactgagtcttctaaaataaaacttaattcttaaaaatgagtccctcccctgtgagtggattatcagtatttgttgtatgtgcatatggggaaaggttacgctacccatgctcctctagacattctggtatattctcccatgtagacatacaaggcagagccaaggccttcctttatgaaccatttactgggggaaaataatgtatcggatcactttactccctgatatggactaatgctagaagcagttgaatctactgtctttaatgggacagagttgtgctcaaggatcattaaccacaaccaccgcccttactcagagataaagatttaagatctcttagcatggtggctaaaggttttcaaactcttgcccaaacataccttttcaatgtcaaacacaatcaccttgctctattcaggaggaatcctaccataatattttgtttacagtctctccacctataataatctttcctcttctcttgagtactgcaaattctacttcagaatagaacaatgtctacatgagggccttcttttgtggtccaaggccattttgcttctgctatagtttatttgagaaaataattgtctgtccttgggcaactcctgtactaccgtcctttgttgcaatctcaactttccacataattactttccaagctatactacgaggcaaagggaggattatgaagggtttagggttactctctcttccgcttcactgtaatttctattctttatttagaaacattctgtctattcctttattattttgtagtctataataatcatacaacatcttattaatatgacactatattttggatatgccctctattatattactaatatttacataaatgtaaacatttttatttccatgatcctagtgacttttaccgtttctaatgtatttatttttaaattaacacataacattgtatgtatttattgtgtacaacatgttttgaaatatgcatacactgtggaatggctaaattgagataattaacatatgcattaccccacattcttatcatttttttatggtgagaatgtttaaaatgtaatctcttggcaattttcaagaatacaatgcattgttattaactatagtaatctccattccttttaggtatctgcttaggctggtatcatacacataataaatgttcaattatttatggaatgaacaaacccaatgttttatttctttaatgaattagttcattctgaaaactaatacttctgtcaatcaacaacaatcaatcaaccaacttcaaagtaacttctcttcgttagagatgactagcagccttagtatcaaattggtgattattaagacggacaacatgataaaatattcaccccataactcccgctctccaaagtgaattctttaaatctcttttgatatgcaaagttcagtgagaagtgaacaccttctgtcacctagcaacgtgctgatcttaaacaaggccagttaacctcgctgaacctggatttctctttctgaacaaagaaagacaagatccacctcctataacttctgtgactcaaatgagctaatgtataggaaatactgtgcaacatatagtggtttataaaccataaaattctgaaaaaattagctgattgaaccagtgagtagagcgtaggcaaagcgatataagagcagtactaatttgctgattaggtgatgaaaattagtaaacactcagattttgctactaataaatgtattgctgcaaaatgtaactgacggttaaactacaatcattcaataataatttgttgaacatctcctaggtataaagcattataagaccaaaagaaatccaagaattacatcccgtataatcctagttgtggatttatatttttctttttgatactgggtgtgtaaaatagactcaaaaaatgattttttcccctttaagatttttgtttgctcattgaatcgtggttggctacatcaggcagagattttaagggaaaacctattttcaacaagacagagtaagtcaattctaagcaactctgcggctaatacatgttgtagggttcatataatttcttcttcacagagacaattgtccctattatgacacctctcaacattgccattgtttatctagaacaatgacatccaataaaattataatgagagcgatacatgtaatttaaaattttctacacattacaaaagtaaaaaacaggtcaaattaattttaatgttatattttctttaacttaaatagccaaattgttgtcacttcaacctgtactcaatataaaaagtaccaatgagatattttatttttttcatacttaggttttgtaatttggtgagtgttttatacttacagcacatttcagtggggactagccatatttcaaatgctcatatggtaggctgttgttaccacattggagagcactgatctcaaaggaaagttggacatttcgtccaagtttttgttcaaataaaaaactgattaaactttgagcaaatatgaattattcttatcagtctcttattgtttcttcctctcaaaaatattcgcaatattataaaaccagcaatgttaaacatactgaactcaccatttgaaaaagatggaagataagaatcattttcacaataaatgctgtaccatactatccccacaccaaagcagccattttgttattttaagaaatacatatgaaaattcttctgtgaatactgaaagcaaatgtgggtataaatctctgcttatgcaataaaatgtatacttaaaattacattacagatgaagaatcatacatagctctacctttgctgtattttgacatttctgtttgcaataaaagctttttaatagaggcacagctcttcatgaatatagtaaggattttagttactaggaaataagaaagaacattacttcaatattgagttcttaacataaatgagagcataaaaattacgtcaaagatatctttagattttactaggaaatatttgccacaatacttttgaaaaaataataggaattttatagacattcattatataaaaaataaaacaccatatatgaaaatatgagagtttaaatcagcatgagaagctttgcattaaaactaaatacatatgaatcatctgtatttgggagcctcagtggttgcagccttatactatctcttagagaaaaatatttcataatccattccaatcatgtatgtattaaagtttatgacaacatagctgtcccccaaccccatgtactttttgaaatatgaaggaataaattcaatttcttaatatattactacacttaacagattatgacaaatacttctctaattatacaaaaaaattaggtttggagaatcccagagtattagctgcattttcaaatgccagcaggtgaagggaaataatccgtggtgggaagactctaaaatggcactcagtgatctctgtctcctagtatttgagtcctttaataatttcctccccttgagagtggtcaagacttttgacttgcttctgacaagcagaatatgtcaaagacaaaaggatatcacttctccaattaggctacataagattgggacttttgtcttgctagcaatttcactctttctctgtctctttcccccctcccccactttctctcactgattttgatgaggcaaattgccatgttagagaccgaaggaactaaacgtggccatcagccaacaagaaaaggaagactacagtccaataacccacatggaactgaaacttaccaacaacaggtgagtttggaagcaggtccttccaaggcaagctttcaaatgagaccctagccctggccaacacctagtgtgcagcctttgtgagagaccccgaagcaaagaatatggataatctatgcctagacttctgacccatatgtatcctgatactctaaagatacagttttaagcccctatctttgtagtaattgttatgcagcaatagacaactaatacataatattataatctttttaagaaacaaatatagtaacataaaaattaaataatggtgaagttgtagggttttcagtataggagtattgcaaatataagaacggaccatattttaacgagttactgaaaaatagtggcgaattttaaagtttcaatgtcagaaagaagaaatcaaatatatactcagatgaaatgataaaaccattaaggtttcatgcaccctctcacatttctaacattaattttcaaattttaagtagaacagtgataaagatgaataatattgtcaatcttctagttttattttagcaccttgcatttaaaacagacaatttatctttgagttgttggtacttcaaatagtttttttaaagtttccacaatttcacacagagacgaatgctaagaatctgttaagcttgcttttagggaaaaggatgcctcaaagtcacaaaactttttaaacttggttctttgggggtgaaaaagcaggcatatttttcaccaattttctaaattttacatgttaaattggaagtaagatttatgttaaactgtttattaaaacatattaaagataaaccatgtgagagaatggaatcaaaatggagaatttcctaccttgctcacttcaaccaattaagaacataattggtagcaaaagatgaagagggagatttcaggtaaaagagaacagaaattaaaaaaaaaggaaggggggagaaaggcaacagagacgagatggggaaaagagcaaaggggattaacacatcttgagagggtgagatgaaagtgtgaggaaaaagtaaaaaattatagcatgaaaatagagatgtagtgtactaacatgtaatatagagttgatgaagacatgttggaattaacttctgaaaattgttgatgaatgcacagtttagaaatgacgaataatagttctattccatttccatttaaaggataaaggcttcaaaatgcatgaaaaattataaagtgaatttttaaatggttcatgaaatctcagctttctgaaactaaattagcttcttttgtttttcagattcgaaactctatgatatggtttggctgtgtctgtaccaaaagctcatcttaagctgttgttcccataacccccacacgtcctgggagggatcaggtggagataattgaatcacggcgggcggttaccctcatgctgttcttgtgacagtgagttctcacgaggtctgatggttttataaggggcttttccctcttttgctcattctcctccttcctgctgccatgtgaagaagaaggtgtttgcttccccatctgccatgattgtaagtttcctgaggcctccccagccatgctgaactgtgagtcaattaaatcactttcctttataaattacccagtctcaggtatgtctttattagcagtgtgagaacagactgatatatttcattccatacaacaccaaccaggtctcataccaggtcttgtagatgataccaaataaactctctgaaacatatttttcctaattctttttgtcccattgaattgtgaaattgtacactttcatctacagcaaatattggaaagtttctgcatctggaagattttgaaagtgaaaagaattatcttatattgccatgaatgacacagcccttgataaatgagtaggaatatgtgagatatttactttaaaattgtctttaaaggcaatatccattctattattgacatcataacattgagtgaacatattatcagccagatttagtaaaactgtacagtgaattttccagagatatccttgtataacataagtcatctagtctccacagaaatgattgaaattccttgactagactaagcagctccattggttacagtaaatccaaacaatttccccctccaacctcaccttctactttatgctcacatctacttttgtttatgatctcaatttcaggtccatgtcttaaatgtagacctactaaaataggacatttactccaaatttcaattccttccctggttgcagccatgttttgagacaccagaatgtaagacacacagaaacagaaaatactgtggaaggaagaatcaacatcttttcaacttattgtgatataaatttgaaaagctatgacatggaattctgattcaattgatatccatgatctccttgtaagtacctgagtactgaagccaactgtcttgatttgggtctcccagtagcaaacccagaaataaaaatttgagctcaagtagttttgggatgtgattccaggacacatcaacagggtgagaagaagtgaaatagggaagatagccaataaagggtatattatcatgcaagtcatcaatgtgaacaactgaatcttaatactccctgttatccctaaaagaagatgtaggaaactaaggctactgtaaccaaaacagcatggtactggtaccaaaacagagatatagaccaatggaacagaacggaagcctcagaaataataccacacatctacaactatctgatctttgacaaacctgacaaaaaacaagaaatggggaaaggattccctatttaataaatggtgctgggaaaactggctagccatatgtagaaagctgaaactggatcccttccttacaccttatacaaaaattaattaattcaagatggattaaagacttacatgttagacctaaaaccataaaaccctagaagaaaacctaggcaataccattcaggacaaaggcatgggcaaggacttcatgatgaaaacaccaaaagcaatggcaacagaagccaaaattgacaaatgggatctaattaaacgaaagagcttctgcacagcaaaagaaagtaccatcagagtgaacaagcaacctacataatgggagaaaatttttgcaatctacccatctgacaaagggctaatatcgagaatctacaaagaacttaaacaaatttacaagaaaaaaaccaacctcatcgaaaagtcggccaaggataggaacagacacttctcaaaagaagacatttatgcagctaacagacacatgaaaaaatgctcatcatcactggtcatcagagaaatgcaaatcaaaaccacaatgagataccatctcactccagttagaatggtgatcattaaaaagtcaggaaacaacagatgctggagaggatgtggagaaacaggaacactttcacaccgttggtgggactgtaaactagttcaaccattgtggaagacagtgtggcgattcctcaaggatctagaactagaaataccatttgacccggccatcccattactgggtatatacccaaaggattataaatcatgctgctataaagacacatgcacacgtatgtttattgcggcactattcacaatagcaaagacttggaaccaacccaaatgtccatcagtgatagactggattaagaaaatgtggcacatacacaccatggaatactacgcaaccataaaaaaggatgagttgtttatgtcctttgaagggacatggatgaagctggaaaccaacattctgagcaaactatcacaaggacagaaaaccaaacaccgcatgtcctcactcataggtgggaattgaacaatgaaaacacttggacacagcgcaggcaacatcacacactggggcctgtcgtggggtggggggctggggagggatagcattaggagaaatagctaatgtaaatgacgagttaatgggtgcagcacaccagcatggcccacgcatacctatgtaacaaacctgcacgttgtgcacatgtaccctagaacttcaagtatatatatatacttatatatatacttatatgaaagatgtagggaattaagcttggagttattagatctgaagggcaagggggacagggtattgatctatcaactgctgctctacaggggcataactgctacatttctgctctctcccaagaatgagcagagatagccccaagcaaagagatgcaagtacaggaagttggaaattaagaagcacgtataaaaatggtaagtgctaaagggatatcggtggggcaccgacagtatctgctacaacacctcatacattttttccttaaatgatctccacaacctgcctacatttggaaagtattgttgtaatgtcaaaattaccattcagtttcattaattgactaaaaaatcaagtcaaagcaatgtgacagatattggttggttatcttttcctaattcatctatctattctgtctacctgtctgtttatcagtcaatcatctttcacccttacgttcctttgaggaactttgcacctacttctctacctttgttgtggtgcagctgtagagtttggttgagatttaatgacttttagctgtagaagtgaggtgtgatttagtacaggaatgagcatgtgacctaattcaggccagtcagtttcagagcagtctttcctggatgctttgggaaagaaggtccctaaagagatgattttcatcaaaagtaagtttgcagatgtgggttctgaaacggcttcaggccatttttgtcaccaagagggaagtcaggtgaagctgctaggtcaacacagaaaaatagaacccagagaaatgtgaaaaaaaaaaaaaaaaaacaagaaacaaaaaaccggaaccttgatcatatttattgtttaaatcagtttgagaccagttttctgtcacttacagcattaagagaaccaatagacgcattaagtcagttacttacaggcatattagttagaactaatcctccatgacacttcacagaaggtgaagattcatgcatttttaaaataattcattctatcattttacttgaatatcataaaaatctctcggttagtgttaacaaataatagttttctttcgtttttctaacacctaaaaccatatttcataatcccataatgtgaaatagtgtgaataatatgtaacagttcaaacattatgttccagaagagagagatttttattttttctttctattttttgaactccagagagagatttttaaatttgcagtttgagattagagctttccaacagctgaagtgtttactattttgagagaagacttgcgaaagcaaaggttaacctagtagtacctgctgtgccttcgttggcaaatgaaggaaaatcacacagatggtggcatttgcctgggagttgggtgccaggggtgtcctctcaaaggcacacaaaaagatagaatgaaatgtctctcttttcttaaatatgtggatgtggatttgttggaaaaaattactttacccacacttgaaaagtcatcaccactgtcaccaccaccacaatcaatcaatttaatagtgaacatgtattaatcctttagtatgtaccacattctcccttgccaggcaagcaaggaattcagctttgttctagactgctgtttggcacagtcttaggttattctccttctaacagtgcaaagcacttagaatacagtcgatacacagtaagttattaataaatattaactatcattacctaacacactgaggaatctttaactctcccaaggagtggggaggacttcaaaacaggaatcagttaaatttctccttggaccgtctagtgcaggcttggtgtagatataaaaagaaataaaatattggtacaaactaaatgcctgacacatctgaggtagaaactaacgaacgttgtaagtgaaatactgctgtgggctgaggataacaggaggccaagatggatcttgtttggagatgacaaggcaggctctatgggattagaaaggagaagtcagatttagagattggtggtattaagagagaaggaaaaaaggtagactttctaagtggaccaggcagggaatcagaggcgaggaagaaaacagaacaaatggaaagaacattgggtagtctcattttgatggcagcctgagtgaaaatgaccagtgggagaaaatatcagaagatttctatagctgaatgacacaggggttggaaacccagggctaaaggagaaatttatcaaggaactgtttcccttactaaatccacagcatcgcccacataggtacagacttgtttgtctaggattttgtgactacatggcagtttgccttatcaaagtgagtgaaaggatggggaaaagggaaagcaagacaggaagagaaaaagaaatagggagagtgaggctcttgtcacaatcaacttgtaattgctgaacagtgtgttggtgctttcatgtcagaggtaacatttacagaaatgacacattttaaggccctgaggggaaggcagattaggatagaagcttataatgtattgctgctttatagttttatcactgtttggaaagtatttcattttatttatagctctgtaggaaaattactaaaaaaattatgataactaatacttactgatgtcttaccatgtgctgagctcaggtttcagcttcttaaatgtgtcattaggtgactacaaaagtaagtgttgttttcacattcatggaacttgccatttgatattgaaatacattcttaaataaatgtgattatgttatacatcattttaatgagcatttctcactttttttttttttgctaatgacttattacttgctgtttattttatgtttattttagactatggaaatgatgttagacaaaaagcaaattcgagcgtttttcttattcgagttcaaaatggattgtaaagaagcagaggcaactcgcaatgtcaaaaacacatttggccaagttactgctaacaaacgcacagtgcagtggtggttcaagaagtttttcaaaggagataagagtcttgaagatgaggggcgtagtggctggccatcagaagttgacaatgaccgattgagaccaatcatcgaagctgatcctcttacaactacacgagaagttgccgaggaactcaatgtcaaccatttcacagttgttcagcatttgaagcaaattggaaaggcgaaaaaactcgataagtgggtgcctcataagcagagcgaaaataaaagtatcgtcattttgaagtgccatcttctcttattctacgccaacaacaacaaaccatttcttgatcggattgtaacgtgcaacaaaaagtggattttaaacgacaactggcgatgcccagttcagtggctggactgagaagaagctccaaagcactttccaaagccaaacttgtaccaaaagtcatggtcactgttcactggtctcctgctggcctgacccactaccgctttctgaatcccggcgaaaccactacatttgagaagtatgctcagtaaattgatgagatacatcaaaaactgccatgcctgcagccagcagtggtcaacagaaagggcccaattcttctctgtgacaacgcccgaccgcacgtcgcacaaccaacgcttcacaagttgaatgaatcgggctaggaagttttgcctcatctgccatatttacctgacctctcaaccaactgactaccacttcttcaagcatctcgacaactttttacagggaaaatgcttccacaactagcaggatgaagaaaatgctttccaagagttcattgaatcccaaagcatgaatttttatgctacaggaataaacacacttatttcttcttggcaaaaatgtgttgactgtaacggttcctactttgattaataaagatgtgcttgagcctagttataatgatttaaaattcacggtcccaaactgcaatttcttttgcaccaacctaatatatctcagtccatttttgtagggccatttttgttcctgtttccaggtgagaaaactgagaccacagagagatgacacagctagtaaggaatttgtggaaggcgattatttggcagccccacaattaatcacgcctcttggattcatgcctttgtgtagtcccttctcattttgattctgaacttggccatatgcctggctttggccaatgggatagtagcaagtgtgatacaaacagaagcttgataagtctttgaagattggtgcttgttcttttggaaggcttcttcacagaactcaaccaccaagctgtggggaagccaaaggagacacatggagaagacaatggaaacaaactgaggctcatggccaatagctttagctgagttctcagctggtaggcagcaccaactgccagtcatgtgagtgaggccattttggactttccagctttcccagtgtcttggttgatatcaggtgaagcagatgaatatcatagtcaactctcagaattatgagaaatcgtaaaactatcttattttaagccagtaacttttagagtggtttgttgcatagcatatataactggaacagagtgaaatcaaaatttgaaccaggcagagtagtaacatgtcgaactaactatacaggattaaaaaaaacagcttctcaaagtgaagcagaactttatctttatttgttttttgaaataaatattctacattggctataccagactacgtgatatactagtatgctattttaccttactgtgtctctcttcctgtttcctgctcttatgtgaatatacagacaatcctttctggtgacattatctttgctctcaggaacaaagaatgaccttattacatttacctatatcatcactacccctttcacattttaattagcaccaaattgtagaaaaacaattatgtaaattattagcagagatagtggcctctctgtctctttcaagattaatatgactgagttgtggtgaagaataagtcaatgacaaggtcagcatccattccagaggaagattttgaaaaaaaacaaaaacaaaaacaaaacaaaacaaaacaaaacaaaacaaaaacaaaacaaaaacacttaggcatttggggaaaggctgctcttatcactgagacatttatttgggtaagaatttttcgataggtgtatctagaactagagaacttcagtgagctttgccttcaaaccaaatcacagtatcttctctaataattatctaaaaacaaccattgcctccacttctggactgcgtcagatccacccgttttatgctctcttgctttccttgtttgcatcaccacaatttgaactaagcaattattactttgatggtgggattacataaaaagcaacgatttttctcatccttgacttcaaaaagctttattgaatcatttagcttagcttacatttgaaaactcagaatggagtggtgggtatgggggtgtggagagggagagaagtactggatttatagtctaggtcttgcataggtggtcgtccagcacttactgctgtctttgtgcctgggctggagagaatgtggagaaaaggaaaaccttgcacactgttggtaggaatataaattagtacaaccactatagagaacagtttggaggttcctcaaaaaagtaaaaatagagcttccctatgatccagcaatcccactgctgggtatatacccaaagaaaggaaatcagtatattgacgaaatatctgcattcccatgtttattgcagctctattcacaatagccaaggtttggaaaaaatttaagtgtccatcaacaaatgaatggataaagaaaacgtggtacatatacacaaatggagtactattctgccatagaaaagattgagatcctgtcatttgcaacaacatggatggaaatggaggtcattatcttaagcaaaataagccaagcacagaaaaacatctcatgttctcacttatttgcagaatctaaaaatcaaaacaatggaactcatggacatagagagtagaaaggtagttgccagaggctgggaaggatagtggaggagtcggggagggggcagcgggatggttaatgggtacaaaaaatacttaggaaaaatgaataatacccagtattcgatagcacaacagggtgactatcgtcaaaataatgtaactgcacatttaaaaataaataagagtataattggattgtttgtaacacaaaagattaatgctggagggggtggatcccccgttctccatgatgtgattattatgcattgcatgcttgtgtcaaaacatctcaagtaccccataaatacatacacctactatgtacccacaaaaatttaaaaaaattttaaaaagagagaattggttgtggtaggagcagatagcataactttcactttataggtcactggaccatgaggaaccatatcttgatctgatggagaagacagtgcatcatccacagacaatggacttttagctggatgcagtaagtgaatgagactttgactggtctctcttgggaaggcactgtgtgttctcttgatgataagaaagagagtgcatggatatttgtgggaccagcatggagattttgaaatgcagtattatattgagaatagtatagctgccttgctagcctgtgttcctttttagagcagagactacgtacctaggctggactttatgtgggaaagatacacatatctatattgtttgaaacatggaaacttggggtatttttattatagtagctcagtctacaccctgagaaatctgaaaagacaatgagaacggctgcatttgtaattatataatccattttaatgtttgtccccctccaaatgtaagatccataaagacaagtgtctgtctgttcataactctatcctcattccttaacattataccatattggaaacacttaataaatactgaatgtatacataaaccaaggtactgtttctatactcctaggattttgcataaagtatctttgaggatctttgtgaccctctagactattggcttttgagaatattgatactgtgtcaatattacgtgagaatcaggattagttgattagaaatctgaatacataggaatgcatcttaactgaataccttacttgtgagggggtgagaaacttaatagattgcaaggtgtggtagattgcactggtgacctctctgtatgcacatctttttgcaatgtgacttttaaagttgctaccatcaggagttgtaacctatttccctaatccctgaatatgggcctgccttgtgatttgctttggttaaaaaaatgtgttagaaatgagtgagccagctccaagcttaagcttcaagaagtcttgtttccttctctattagaatcctgtttcttgcatgagaataagcccaggagcgcttgccgaaggatgagagaccatatggagcagaggtgaatcatcctagctgcgcttatgctagataagccagcccctagcccacccattagctgactgaaaatgtatgagtgagccagaacaacacaacagctcacgggaccccacagactgtgtgcaattataaatggtgataattttaagtcaataagttttagggtgatttgttacataacactattgcaaattttacactattggagttattacttaactgatatataggggaaagccagaaatgggagtgaggcttggtacagttaagagttcttaaataataccagagtcctcaatcctaaaattactgattttgattttgaatgagtatctaaagtcaggctcaattctttgcaaagatgtctgaagagacattcatggcaaatcaatgggggtaaccactgaaaaagtgattttagaagatcattattagaagacctaataatagctagtattttttggccacttactctgtatcagctgttgcccaaagcagtgaaagagggaaagaaataccctgaaatctccccttctcctgctctccaatctcctgccaacgcctcccactggttaaatctatacagaagatagttgagaagaaagcctgaggaataaggtgagtggaggtgagcttcttgcaatatacaatatattgcacagaaagaggaaggaaattgagtgaatctgtgggaaagttatacttgggttatgaaccccacaacgatctatgtttcaaaggtataaatcatttgaatgtgttcatattttctgtcaaagttgatatgtatcttctgtggtcggatgaatgtgcttcataaatatcaagagacaaaatctttttgcaaaggcctttccagtatctcagaacacactgtatgcattccattgaatgggattggtggtcaactcctacacagactcttgatagccactctctacctccctaccatttaagaagtagagcaaggggaccagggaaccagcatcttgaaattagggggggaaatgcagaacctcaggtcctatgcaagagccattgaatcagtaacctgattttaacaagatctcaaggtgattcctgtttcagtaagtcatcaattaatgttgttgatagattctgggaaactgtgacttaggcaaaatgacatataatgaaaccaatcttaccataggctaattgataaacaagaattaagttcctactgcatacctgtgttcacaaaacatgatccaacatctaaataaagaccccaagcacttctaatattaaactcagaaataaatgtgagatatacatccactttagaaagattaataaaaaccaggaggaaaattatttacccagtttttggtgaatcagtgagtgacagtgtttgcagtggcggtggttcattcaaggaataaatgtttgcaaagcataaactgccaggattgccttctctcaccacaaagttcaaaaacaaacaataatcaatatggcagctcactgagcacttctgtagagcatcaattattgtcacgcatctttatgattattgaatactatatgaatttttatttcacagtaatttatattaattcagtcattcattttccaagccacgtattccagttcagggacttgggaggccagagcccatcctggcaactcagagcaccagacaggagccaacactggcagggatgccattctatcgcagggcacagtcgtagacacataaacactcacatggggacaatgtagacacaccaattcccctaacgtgcacagtttgggacatgtgaggaaaccagagtactagaagaaaacccacagagacaaaagaaaaccccacatagacagtgcccccctagctgagatacagttttttcccttgccaatattataacacagtgatgctcaatgaaacaacattattcaaggacctgccgtacattaaagtttgagaagttctgctctacgtgatggcacgtggatctttaccccttaccactgctattagaattttatggtaacctactttgtaatagtaaccacaatttaactcctcgtaataaagtatgatagtatatattgtgtttttagttcctcactagacgctgggagatgggcaaacatgcttcataatgcatcactgttggacaaatgaggaactagaggcactaagagatttaaataagtggcccacagttatgagttagtgagtgttgaacctgggtctagactgagttatgaactgcaagtttagtgatctttccaggactgagatgaggcatggagaataagaaggtggaacggtggcactcattacacaaaccattagaatatttgaggccacgttgggaattaaccacacgcgaactgagaagctggaaaggggtatctttaagaaaactaatccttcacccgaagtagaaatgattatttaatcatactgcattctagtttcagcataaagacttgaacatgttaatgtcaacatctttttttttaatctttttttttttgtttgtttgagacagagtctcactcggttgcccaggctggaatgcagtggcgtgatctcctttcactgcaacctccgcctcctgggttcaaatgattctcctgcctcagcctcccaagtagctgtgattcaagtcatgtgccaccacgcccagctaatttttgtatttttagtagagacagggtttgacaatgttggccaggctggtcttgaactctgacctcaagtggcctgccctccttggcctcccaaagtgctgggattacaggcgtgagccaccgtgcccagcctcaacatctttcttaattattttagtaattaaaatagtttttgtctgctcccaaactatatgaaatcttacccatagagtgtcttttctattaattttcctgttttgtgtgttggcctttatttgttctcaatgaataagggcctatatagcacctgaatattaatttttttctcttccttaaccagcagctcagtgattctaacatcactgataaaatacacatcactgatgaaaataaaacaataaagcaacctctaggagataactgcaatggtctaaaatttgtcacaaaagtcatagcaccaacagaagcaatcttcatgatagtcatttacattgcaattgagttcagaatgttcattcttttataaaagtttcaataagtccaagaagtactgtcctattcaaaactgttgatgtcacccacatcacagtcagaatgtgtcactttcacaaaaaaatatttttagactgcatttgaggtataagcatcagtcatcagtcacaggttgcctgcagaatgtaaccatcagaacaaatagagttttcttgaaatacccttttgatgactttggtttccggcccatttgctggtccatctcttttcccaccacacttggccaaccatgccaaagatggactatacttgtcccggtgataactgaaaatgttcacaaattataagtgcaacattcagctcaaatgctttcatttccacaacaaaattgatggattttctctagcaacaaacaatgaaatgctctcgtcaatgtcttgtaattggttctaatatcagcaagccaatcaaaagggagaaaaaccaaatttctccatcaggcccttatcagcccttttgttacccatacagtggtcttgccccgaaccataaggtggataaatgaggggaatgctgattttggcatccagcttactttcagataatctagctcatccttctcagctgacacgagacagaaataacatcaaagggtgataaactctttcttgcaaacctggggttccatggttcactggccccaggcctaatccaacaatccattttctacacaataaaaggtaagaaacccattacagatctgttataagccttggcaggtggtatacggcaaaaatggaatacacaaccaacccagcatttggtatcccttttctatggtttgaagcactaggggtcagctgacatgaatatagtagtcagcatttagtattaagttattttagctacataaataaactcacatcttgatgtatgagtataaagatttgacagaaaagttcatttttggtatgattctgatctttaataaaaatcaccctgttattttacttttgtatggcatattggctttgcaggtgatataataaatgaaactgggttagaatttacaatatgtggtcttaaatatggcctttaatctttgttccttatttaacctcagtttaaggagttggcatatgaaaacttccatttaatatcatttcacgattattaaattattagaaaggaaggaaactccctctagtctcagggttggtgctatgtaagtaaaagcattgcagaaacaaaaggaaagaaaaaacattttatattagcaaaatccccttttattatgtcatttcttctcctttctagaagtcattgcttcaggcaaacacctttgtgctaataaaggagttacttaaaaatgctacactgaagatgcagagttatgaaatttttctcctcctttctcttttcatcatcatttatactcttcatcattttaaatccatcatgaacggggaggagagattgctaagaatagtcgaatttgtttttagttgaaaattagcttaacttttaaataaaatctagggcacagcatacttaagtgacacatttacatgcttgatatacattttcagtatgtagatagtggcaacaatgaagtttcactatggaaattagttgttacacaagtatcagtgcttcacaatttatgctggatttttgttatattttttaaaacattattatattggaatgaacaaattatcttgtatttggtgaggtttcctaatagaaaattatctagcttcagtgtaaccttctacaaatgcttttcctttactttgccaaaatgagggaaactgatgtcaaaaataaaggtagggggaagggatggggaagcagtgtgaaagtttacttgctttctgcttggatttctgggttacaatcaggccaatagattgataaaaacgatgttcagaattaaaagtcctctgaattatgttcatactttaaaagtgagaatgctggtgtttgaaaacaatgctggctttgttgggcttcttaggcaataggaggagaaaaatctatcattttccaacacattttagctgaaatgctagttggtcatagaaaatgaaagtaatatcagcggaataggagagcagtggctgaaaatcctctgtgccttccacgagagccatttggttgtcttgctgcctctaactctcctctccttcacctgttgcattcataatagtagcacatagttcagctttctccccaagagccatatttacaactttgattaagaaggtgagacttttggagaatttggaggtgagaatcagagatgattttgtgcttgctctttgcatttttctattttagtattactcctactgtttttaatctaacattttttgagcaattacaatatgccagatactgtgttacacatttcccatttactacctcattgaattttcaccacaacctggggaagtgtcttcttttagtatttgaattttatggatgttataacttaggtatggacagagtaggtataagatcacatagctggtagcaagtggaatccataattcataatctcatcattaatgcctgcagtaaattacctcctcatcactcctgtttactttttccttgtttgtaaagtgtctgatccatattcttggcattgcctatatggtattatagtacatactggtttctatccaggttcctggctcataacacccatagcccttgttacagttttttgttataatgttggttgcgttgggtctcaggggcaggcctctgaccttctcctgctctcctttcactttaatgttccctcgcctttcagattataggtcttaaaaacctcctgttagagggtcccaccatatacccttggggaaggaatgctgatgtcatgaagcttccataaaaaacaaagaggacagagtccagtgagcttccgggtagctgaacaggtggggattcctagagggtggtgcactcagggagggcatggaagctccatgcccctttccgtccctccaccccaaccatacctcaccctatgcatctcttcatctgtgtcctttgcaatatcctttatcataaacaggtgaaagcgagtgttttcctgagttctgtgagctgctccagcaagttagttgaacccaaagagagggtcatgggaaccccaacttgaagcccatgggtcagaagttccagaggcctggacttgagactggtgtgtgtgtgtgtgtgtgtgtgtgtgtgtgcgcgcgcgtgcgctaggggggtgcagaggaggcagacctcggtactgagccctcaatctatgggatctgacactatctctgggtggatagtgtcaggactgaattagagacacccagctggtgcctgctgtttggtgtatggggaaaaaaattccacaaatttggtcataaaagtcttcttctgtgttgacgattgttacgatttgagagtagagaaaaaacacggttagaaagaattttccatacacagcgtaacatttcaataatttggaaagttaaatgtcacgtattcttatatactattgtcattaaagagtgattaattcggtaataatggcaatcagatttcttggataggccgaaattctcagctgaactaaagtattaggaaggtagatgatgatgacaaggacgatgatgctactaagaacaaaagcaatcatgataataatagttattgagcactggaccaagcctagctctaaaagcctgatgtttgttctcataactagagtgaccctctctatatattttatcttctaaagtggaatacttatgacaatgaaagagggagctattaaaaattatgataggataacaggcaaaaaccagaacagtcagagcaaattgagatgtactcatgacacacaacctagtaataaacctcatgtcagtgtgaaattataggaggcaaagtcaaggatgcttatgttataaactttaaattactactcccttcccccaaccctcagcttcaaactgtttagcaactataaattagagatatgaatatttataatgccaagccctataaaattatgcatgtcctttaaataagggaagggtgggaagtgattatgatatgcttagaacagaatgtggcacatagtagtcctttaatagatagctcttgaataaataatttaattacagctttgctgtaattattaactacataaagaaaacatccaaataatggatttccaggaacttacataaagaaaacattcaagataatgggtttctgggaactatcagactatatgcccaataaataggtgaacacccttttttttttttttttttttttgagatagagtcttgctctgtcgccaggctggagtatagcggcatgatcttggctcactgcaacctcctactccctggttcaagtgattctcctgcctcagcctcccaaatagctgggattacagacacatgccaccacgctcagctaatttttgtatttttaatagagacggagttttgccatgttggctgggatggtctcgatctcctgaccttgtgatctgcccgcctgggcctcccaaagtgctgggattacaggcgtgagccaccacacccggcccgttttcttatataatagcgttttagcacacagatttataaaattaaaaactgtgtgaactgtgttacaaatacacttcaagggagaaaatcatgagcacataaaagctccagtggaactatctggtccctgctaagacttccagctagagaaatgatttcctataatgattattatacttcctactatatattttacagcatttttttttccggggttccataaataccagtcaatatggtaacaatgccagtgaagattctattatttggttgaaaaaacatcacgttaagggcaggactgaatggtaactattagaacaatctattaatcgtcatcttgtgataggaaattgattggacaaagtgtccatttttgagcaaggagtcggaaagccaagctctagctttatttaattttctcctttttgctattcacatttatactgacgactaataatgactgtcattacatagcaaatacgtctggaaaaagactaaacattcatttaccttatacaaatgaaaataaatctgaaatgtttactcctcagatacatatttagaagcaacatgattagagattaatacaaaatgaaccagatttctggaaatttagatacagccaactgtatattgtggaagatagtttgtgctaggagttgcactgtatttttactttcataatttttatttggtgattttttgaaaataatacctgtattattatcaatattacaaaaattattcccatattaaaggtttgttatatatgttgtatttgtaaacctacctttttcctcggtaaagtgaataagatgcacttaactaaaattcactttccagccaaatttcttaattgttttccaaaatgcttttttctttatgtgcaccattttatactgtctgggcagtaacaaattcaaatagtaatttaccatttacatataaacagtatatcttatttgtaaatggtattttatgtgtagatagtaaattactgtttacatgtaaaatgcgatgaaaaatttaaacttatttaacaaaatgacaacatatttattaaaactaataggaatgcataacgtacaccacctgtaaaattacttgacattaaaaatagtaggattttaactaattctgaaacaacataaacatgttttgctatattacacaactgtaaatgttccacagcagagaaggttctagaaagtaattttaaaacacagcatctagttctcaaaaagggcaaaaaccaaagcaaaaactcatatagtttttttaaaagaaaataaatccccattttaatattaggatattatccacataaaaatcacttgagcttcaccaaaaggttaaaacccctactgtttattttggaatcacttttatatttaaatagaaagctacatggtctcaaataagtcacataacctttctaggactcggtgttcaaaaataaagaatgataaagcatattttggttttaaataaatgggtagttaaaaaaatacccacatataacatatacaaagagcaatgaagaatgaggaaaggggacacaaaataaaaagacatgaaagagatgaaactgggattaacggggtcagggaaggagagcagaagagaatgtgttacataaacaactggggcagaaaaagagtggcaaatatgcaaatagaaaagtagattcatggccaggtgcggtggctcacgcctgtaatatcagcaatttgggaggccgaggtgggcagatcacctgaggtcgggagtttaagaccagcctgatcaacgtggtgaaaccccgtctctacttaaaatacaaaaattagccaggcgtggtggtgcatgcctgtaatcccagctactcgggaagctgaggcaggagaatcgcttgaacccaggagacagaggttgcagtgagtggagatcgtgccattgcactccagcctgggcgacagagcaaaactctgtctcaaaaaaaaaaaaaaaacaaaaagaagattcctaataaatatataaaaataaattcctataatatacgtgtcaattcatagatgaaaattagcctaaaagtgagaaacacagaggaagagagtgatgatgatggcgagagagcctcctacacccacatgcatgttcagagaaaatacaaagaaatatgaagagggataaatattaaaaacacctgagtcagaagtgtgggtgaagatcatagaatgagatgatcagagagaggaacacagaggctagctttaataacatccccactttgtggctcttacgggtatcattgttaaaggctgtaaaaggtcaagttatgtattagacaagaatgaggatatcatttcatgagccttcattgcatgaagctacccataaatttacgctaatggctatattcagtttaaagcaaccctgtccaccactcccttaaagaaatagctatattatcttcacctgctgttttctctcttcagtaatgaaatataaatgtacaggccgggcgcggtggctcacacctgtaatccccgcactttcggaggctgaggtgagcagatcatgaggtcaggagttcgagaccagcctggccgacatggcgaaccctccatctctactaaaaatacaaaaattagttgggtgtggtggtgcgcgcctgtagtcccagctactcgagaggctgaggcagaagaatcacttgaacccgggaggtggaggttgcagtgagctgagatcgtgccactgcactgcagcctggatgacaaagcgagactctgtctcaaaaaataaataaaaaaaaaaataaaataaaggtacaagagtaaggggtcagttggctcaatacgcagaatgcagcatattagagttagctgtggagaaagtcacctgccaactgattatgatattaggatatgtttggagatactatgtactaaggaattgacatattcatgtcacagtaactatgacccactagttccaattatatcacccactctaacctttggatgaagggtagggctggaggacacagggagggggtccgctttatttctaccctcctgtaataagtaagagcttgagatttaatgaagatcaagactgtctgccagtgttataagccattttcttttacttttaaaaaaacttgtgttatttacctaaatctggtactgatcatttgctttctatccctaaatctaaactaacagggatacagaggcatatggatggagaaaagatgattaaataattttaatatgactaatgaataaaattccaaatcctgtggcatttaatggcaaagacattgcattaaaattataattttggcataggaaacagatattatggatgctgtagtaatataagtctatacatgatggtgttcgtaacctcagttttaattttctatcataaaaatttgactttttattctgttgcaggacacataaaaccttgactctttcacaacccacaaagctgctattgtatattttagatagttctctcacatttcctacaattataatttttgttcttctttttgtcataagatgtactgagatattgtagaacattttgggtatccttcctccttgttctctttttatgagggatgatttcatttgtattgttatgtagctataaaatttaattgctgggacaccaccttccctccatacataaaagtctgtatctttacacagatgttttgcaatcattaaaggtagaaaccaagaagggatttttttttttcaaataactacctgcttgaaatagagacacttaagcgcacattatggttttaatgtcataaaattggtacttattttagttcctaaatattttatcagtcgtgtaaatgatctgttattagaatgtcagcatcaccaatttaaaaaatacaataaataacctgacacaattcaaaatgttcacaaattagatgactcagtatcgtaaagatgttgactgagctccagattcacaaaatttcaatcaatatcctggaaggctttatgtaaaaatagacaatatagttctaaaatttattcaaagaaccaaaagtagccaaggcaatcttgaataggaagaacaaagtggaaggtttacacaaccagatccaaaatgtttaaataaaatgattgcgtatatacatacaatggaatattattcagtcataaaaaggaatgaagttctgacacatgctacaacatagatgaaccttgaaaatattatgctgagggaagtaaggcagacacaaagtggcaaatatataattccaattatataaaagatctagaatagccaaattcatagaaacagaaagtagtccagaggctactagcggatgggaagagagagaaaggggaactattgcttaatggttacagactgtctggttggagtaataaaaaattttggaggctgggcgcggtggctcacgctgtaatcccaggactttgggagtccaaggtgggcggatcacctgaggtcaggagtttgagaccagcctggccaacatggcaaaaccccatctctactaaaaatacaaaaacttagctgggcatgctggcaggtgcctgtaatcccagctactagggaggctgaggcaggagaaccacttgaacctgggaggcggaagttgcagtgagccgagatcgcgccactgcactccagcctgagcgacacagcgagactctgtctccaaaaaagaaaaaaaaaaattgggggtggggcataaactgtggtgatggttgtaataaatgccactgagctggacacacgaaatgactaaaatgacaattttttatgttatatattttatcacaccttaaaaaagtaacaccgaaatacgattgaattgttcactttaaatgagtttaatggtatgtgaattatagctcggtaggattgttttaaaaaaaagattgtaattaagccagtgaagtactgttgttaaagtacagatttaatcaaatggaagaggatacagaatccagaagcagattcatacatacaagttctcttgatttatgacaaagatgccatgaaaatacagtggggaaatgattgtctttgaatgaatagtgctggatcaattgatgttgctttttactataaattcatatgtaccacttgctttatataaaataaatatgtattaatttaataaatagtattactgttagatttatatagtatgcaaggtggaaagatgaaaactcacaagttaataaatcagtaggtaagtaaataaataaacttgtggcgaacgttagtgtacattaattattaagtccataccacaggtgtgaataattaattttgatttatgacacttgtttaactagaaccagaccacgtcctttcagcttaaatactgtcagtacatgcctggccactgaattaaatacttcgccatttcttcagtctgattcttcagaataatttatgcaaaaaattgtggtataaattttggcatttggtcattaatgtaaagccattcaccatcatcattttttctagccacaacaaaacatatagccaaagcaaacggtcaggttaaaaaaacaaaacaaaacaacaatccacataccagcctcctccccgaccaatgaagcacccaggaaacaaaatacatacaaatacttgcaacatttaacacatgtgacggaagagatggttaatgtctaacctttatccactggagatttgtctgcttgagcttattttcaagtttatcttgctcttctgggcttatgggagcacttacaagcacgggtcctccagtttcatttaattgtttgagaattccctggcgcaggggcaactcttccaccagtaactgaaacagacaaatgcaacaacgtttaaaatgaattacagcacaattccaactaccttgtctttgcttctattgattagtctatcaaaatgaagcgacttgaccgagggcccagtggtacctcaaataccaacagttttctatctgagcacagagctgattgactgaaacactcaccccctcagtagataaatctctgtagaaaataaacgattatattatccctcataaattttttaagagaaaaatgtgagatggtaaagcaacactccaaataaagttagtgtctgaaaacctatctctctatcagaaatagaacaatgtgaacaaattcatcagcctcttgggtatcatagcatgccatagcataccgtagcttgctgctgagaaattgcattatcatcttaagaggtaactgacattgagagtattgactctcaatatacacagtgccaggcactgtgctaaccttttcacatttattatcttagtttatcttcatattataataattatatcaggtagatccaattatcttcattttatatggaaggaaactgagacaaaggggttaaataccagctcccaggacacaaatctagcaagcaacaaaggtgtggttcaaatttgggtagtttcattctggagtcctcattttttacttcatatccctaaatttctcgaactcattcaccaccacatagtgtatgccctttcccaagacctccaaaatcaccatggtgttaacacttcatttttgtcaactaaagttactgtgtctgctacagtacccattagccatacaacgctattaacattcaagttaatcaaaattcactaaaataaaatctcaagttcctcagtcacacgaccaactctccaggtattcaaaaggcacaaatagctagtcgttacaaaaatggatgatgcagaatattttcatcatcacgggagttctatttgaaagcactgatctagattctttcaggagaaaatagactcatgcatattaattaataagaaaatgccactaaatatgtttcgaatgaattatcaattatattactatatatgacactcaatacatttgggaaagataaatttccaagaaaagactgagttcattgttctagggtataaccatcttcaaatgattcccactcttttctatttttgaatcccaaatacctagtaaaacatcggatgtatagtcagtgctccatatttgtttattgaattacgccatattttatttttatactttatttcttgttcaggtgtaaacctcttgtttcacagaaataaacgtttgacattggactctaatttacatgtgtaaagcacctgaatcattgataaaggaccaatttcatttccctttgattatgtgaccgtgtaaaatgaggataatagcaaccattgtcaaaatctgatatgaagattaaataaaatagtggctgtaaatgtatctaatacttggcacataacagggaatgattaaatattaatttctcttcccctttcaccttctgcttgacaactaaaatgaaatagatccaaaagagctgctttcctaaaactaaaaccatgaaagttaatccaattgcacaatcagagcatgtcagtcagccaagggaagtaatcagtaataagcagacatcacagtaggacggtatgaaaagccactggaataagctggatgtctattcaaccaaatggaatgtgaaccaacaccacgtcccacacccccagacaaatcagctaaaacaaaacattgcttcgggggaatataatgcctttaagtagaggctgaagtggtgagactgatctggcaatccagatcttccctaagaaaatggattcttctttttaaagactcttctcaaatctccaggtaggtaaccaggacagattaaaaaagtgattcccatttagatttagattttatgattccacaatctggtcttcagtttttaaaattatatgaagttgtgaagttctcaagtaaaatctaaaattaatttcaaatcaaagataaaaactgtgaattatatacatttagacatattgaatctatacatctatatgtgtagatgtatagatgcaatatgtgtgtgtgtatatataaatacacacacacacatatatacatatgttcttatgtgcactggttcagaactgcagggttaagaagaaataaagttgtgagaaaaacactttagcaaggaactatgaataacctaatgggcagaaaaccaatgattgaattaaaaaatagattcatatacttctttatgcaagcaggccctgggggatttgagaaaataaaattaccttgacttgctcaagcttttcttttagttgctgctcttttccaggttcaagtgggatactagcaatgttatctgcttcctccaaccataaaacaaattcatttaaatctctttgaaattctgacaagatattcttttgttcttctagcctggagaaagaagaataaaattgttatttttttttccaacatagttctcaaactatttgttaatgcaaactgggacacaaacatggcaatttaaaaataagcaatttaaaagatgttaaccatacataatttaagaaaattcattcactttgaacaaagtaatttcaatatttcaagaatctctaaatgataagagattaaaatcgaacaagaaaaattctgattcaaaaattcctggccaggcgcagtggctcatgcctgtaaccctagcgcttagggaggccgatgtgggcggatcacttgaggtcaggagtttgcgaccagcctggcaaatatggtgaaaccccgtctacactaaaaatacaaaaatttgccaggtttggtggcaggcgcctgtaatcccagctactagggaggctgaggcaggagaatcacttgaacgtggaaggcagaggctgcagtaagccgagatcgtgccactgcactccaccccgggcaacagagaaagactccatctcaaatacatacatacatacgtacgtacatacatacatacatacatacattaaaatgaataaaataaaaattctaacaacattatgtcattatatctgagcaaggtttctcaactttagcattactaacatttaggtttggaaaattctttgctgtgagcagctatcctctgcattgtagggtatttagcagtatccctggcctgttgaacacactggataccagtagtaacacctcgcccctgagctgtgacaaccaaatatgtttcaaggcactgccaaatatgctggggggttgggggtggggacaaaattgtccctggttgagaaccaactaaagtaagtatataacctaaagttacaagttttaaaatgtttaattaaagtatacttatggaaaatgagaggacaaaaatataaacaaggtttttgttttgtttaagtagcagccattttatctgcttcttattctgtgggtcaaggatttggatagggctcagttgagcagttctgctttatgtggcttcagcttggtttaaaataaaacactaaattattacatgctaaactgttttccgaattatgactcacaaccttatttgaggaaagagaaaaactgatttaaaatacttaacatatgttgtactcgtggaagttttaattatgaaaatgcatataactctatgctaattagccataaatttattcttacatattcgattgtaagacagctgaacaaaattgtttgtgcttaaaataattgaaaattttttgttttgttgtcttttgggaactatgtgtagcttccatggaagcttttaactgaagtgtaatatacgtacaggacactgcacaatttaactgtatagcccaatagtgttttaaaaattgaacacactgtacaaccagagaaggaaatagaatattatcagaatctcagaaatctcctcttatccctttgcagtcactgcctccaagtataaccagtaccctgtcaactttgattattttgccggtactgaatattatgaaaatggaattgtatggctttatactcctttgtgtctcgcctttttcattcaaaattatgtttacgataatccatgttgcatataattttagtctgttcattaacctggctgtatagcatttaattgtgtaaatatagtactttagatggacatttgtgataattcagttttttgaatgattagctatttttttttttttgcttcaaattaacaaatgtgtattgggagcttactaccttctaagagctcaattgggcattaggattaaagatatatacgttatataccttgtcttgaggatttcatagtcaatgagaagaaacaagcatgtaagccaaggattatgattaagtattataggaggagaagttatttctggggcagtgcttgggagacatcccagagaagataatgatctgagtcttgaagcatgaagatagatcagcatgttgcaggaataagacacagcctgttcaaagacagggccttgagagaactacagttgcgatcattctgtaaatcagaatctggttattggacttatgcttgcatatattcattcagttttcctatatgataagagcctgttcaaagtctgttctgggacacgtaaagttacattctcccctctgtctattctcttttaaattcatttatacatttattcgcttatttttacaaatgtttatgatttattgtttttaatttttgtagggacatagtaagtgtatgtacttgtagggtacgtgagatattttgatacacgcatgcaatgagaaataagcacatccactgttcattcctgggacactgggagcagggtctgtttttaacctatcccgaatataacatctgatctagaagtacttctgccttatctgactgggaagatgaatgctatttacttcagctgagagtatattttgttgtctcatatattttggggaaactactagtttaataaatcaagagatctggagctcggggagagaggaaagctggaaataaggactttagtcattagcaatcagttggcagagaaaacacggtaaactaacttttgaactaataattaacatttcatgtttgctattttctgagtccattctttcttcgttttatgaattttaatcattgacaattctctcttatttaaattgaaaaataggaaaagtcaatttcaaagccttttgttgatttcttatgtatggttaaccttacggttcctcctcttcttctactctatgtgcttggccatggaaagccaaaggaatgcctacggtgctcttctggcctctccaaaagctacacagacctgggaaggaggtctgcagattccaaacattcattgaagtgagaggatgctttttccttcttggagtctacatacttactctcagtgattctctcgaagtctctacttctgactcagagagatgaaagagaaggaactgtcccttaccacaaactgcactccccacaaagcttactaccccttcctacctgagtctttttaatcttgcctgggacacggagtacagaggagattggaaattgcttggaatagagataataatccctgttgctttagagtaaaccctatggggaagtggctggtctcgattgctggcagtttgttttagaatgtggaacagcaccatttcccctcagattctgaccttagaatcaattgtggaagaagaaaacgtctagtatagtacaggcatcctttatttgtttaaatgttccaagcagatttaattccttgggtctagattttgagggtctatctcatctttttctctctctctgtttctactctgcaaatcattgcctccattactatttgactccagatgattttgcacagtgttctgaatacttttagttaagtaaaatcttgctaaaatctgattacatttgaaaaacctagacacattggcaaggcttttaaacattttcaactttcatctagaagcagacacgtttaaggaaaagaaaaccccaaaccccccaaacaaacaaaaatttaaggagcaggaaaaagtaatatcaaaccaaaaaaataataataaccctcaagtttagaaaattctaaatcaaacactcccctcttttcaaatatgtctcaaattatttactagcatatttttttctatcaagaatatccagtacagaggagagatgttgtgcttattcatcatagttgagatttatatgtattactgggttcaaaccctatattgtatgcttattttcttcatttattattctactatgtgtctctgtaggtcattaattacgctttaaaaacttgattttttaagatcctagtaataagatatataggggtaccctatatttcaccattattgtgttattaggaattttgtttgctttcattttttattataatgaataaccctacaataaacacatttatttatacattttgaatcatgtatctgctggaatgagaatgaaaagttaacaatgggaatcctaaggatttagatacacattgttgaatttctgtcaaggttggtactcagaacactcgtaaactcccaccaacagttacaaaatacttgtctcactacacttttgccactattgagcattataattgatataccaataaaacaaataaaaagcttgccatagatattttaagtattctactaataggaaagttgaaaatgttgtatgtgtgtacatgtttgtcatttatttagtttccactgtcaattatcggcaatgtctgttgcccatttttcctgtgttttcctatttttaagagctcttttcacattatctgaaacatagattaattgagactacgtttccagcttcctttttgccttttagtagttttttctaaataaaatttaacagtttatttctttgatattatgttcattgatagtatccttaaaattgtggccattttaccattgttcagatattctcatttattcttgatcctttactctttcatttgttaaaaaagaacaaccaaatatttaatccatcttaaatttatatagtgttgtttctaaccttgaagagtttttcagaaactgatattttttcccccagcaccatctcttctgaattgatttatggtgctttcttcatgatattttaagtttctgcttgttgatctactgtagatttttgtgacagtaatgcactatgtcaattattgcagctttaaaatatgtttaatttctggtaggttaacccgctctcccactttagttattctaacttatgtaatgtatcattcagtcaaattataaaacaattctcgctgaaaatttttaaatgggattgcattatatcaataagttaatttgtgaagaattactgcctttccaatataattctgctaaactttctgtatttacagtgttcttggacacagagtatctgggactcaatgggacactataaataattaagtacattttataattaaccttcagcatcaatttgaaagacagcatcttgcatatgattttatggatattaaccatatactaatttagaaaactcttaagaactctcagaataaatcatcacttaaacagtaaaagctttggctaagctttttgctgtctttctttttacacgatatttgtggaaaactttttttccagtgatttaattttttaaaaaaacagcatcttttaaatatgaaaacatttggtagtcatttcttatctagattttttttatactttgaaatataaaaaagatggtgacaaaatcccgttgggaccttgttataatctgcttttccaagcgcatgtgttttctgaaatttcaaaagcctcgatttgaagttttaaaagctgcaatttgaatttatgtattcagatgattgcagaaaagcaaagaaacacagttagcatttccaggcttgtctcttgacagaacagtttaaacgtgcttcatattggcattcatcacatgaagtgttatttctttgtttacctacttgcttaatgcttatgggaggatttattcagacaagtggtagtaataataatgagtgagatatttaacattacccatctgcaaataagtgctaaatattttacttttagaagcatttcaatacatttagacatttagctttttttagaaagaatggcttctgtttgaaatattggctctgttaccatttacattacaaatgttcccaatgaaattaaaggaagcacgtattacgatggtgagagatttgcataatcagaaaggaagcgctactcatgtgttgctaaattcaatgaatttaacattaactcttaatgaacattttctgtcgggctactcttacgctaagaggaatagactgccaaatcacatggcatgattttggtgaggggatctaacaagtgtttcaggtaaagtgctagatagtttcacagtggaatcttttaatattccatacatcctttggattgccttttatatgctttcaatgaagaaactgaagttctagagattgatacatcacatacccaaaggtgactatcccattttccaaatgagaagtccctctctccaagttttttgatcacctttaacatagaaactttagaaaatggagatacaatgatcacctgtttacatataatgtttaattcattaatttgattgtgtgtactactttaaaattatatagtacaaaatattatgtcattagatcacacttcttcattcatatttcatgcaacaattttgttcaaattcttcacaggcaccttcaacattgaaatttgcatcctcatggatgcacttgttgttgcctaactcagttttccagagggcatcatctttacttacatccatgtggcctgaggtatagtactgctgaatctagaggtaatgtttcactaggaattttactgcaagccacaagcacacatttacataacagaatacagttttatgttatgtaaagacagctttatcttttttctgtgccatatgtccatgagctacaccatgtaaccacttaatgagttacttttaacagtattctttccatagcttgtttacaatggcatccaactcttgcaattgtgatgtcatacaaccaaagtcaatccctaaactgtgttaaatttattttctcccagtgtgtgtgtgtctgtgtgtgtgtgtttttgccctcctctatcaggtttacttctacaagcctccaaaataagcataaattgagaataagtcaaggcaatacatctttcccggacagtactttgttgttttgattgaagtaaaataaatgaccatcttgtaatttgagaaacttcagaaggattcaagtataagttgacccttcccgagggaaaaccaaaacaaaacattgatttctacacacacctagtaacctcctcaggccataccctccgtaggtcattatcagaatcagaacccaagcatcaactttatttttaagccaacatgtctaccatacctggttggtgcttgagttgtacaagtagacatttgttcattttccctaaagtttgtgtcttgtcggaatgaagtgctcctgagggggataatatatcaagatttctcagtcatttatgcctcactattaaggaaatgattagcaacttttgagtagatgtggaaaacgatgagggaaaaacctgaaggttagcaatgcgaatatctgtatggaaagtaagtccaaatctaaatgctgccagttatcagctgagtacgtgaacacgggcgagttccttaatctctttagccctcagtttcctcgtcttaaaattagaacaataaacattttagagtgttgtgaggattaaagttttttttgcagaaacccaagatttagcctagtgcttcactaacagcactcaaaaaaaatggtagagaacataaaaggaggtacaaaaaagggaaaatatggatacagagctttctgttttaatcctagaattgtgtctaagcccacgtgcttacatagataaaagtatttataaaacattatgagtacacaggaggagtactcaaaattgaacttttgatgagccacctgacaactttatttctccctactgacaaactaccttgacaaattttgctggggaaaaaacaatagagaattaatgtcaatctatgagtaaatgtgccaccagatgagactacttctaggtgaagcatatatgtaatcacaatgcaacagccatttattgagggtctactagtgtccattgatatggccgtgaatatcggcagcaatccctgcctcatggaccttacatccgattgggaggaaggggaggcagacagtaaacaagataaagaaataaaatctatagattgtgatacagtaagtgttacagaggaaaaaaatgaagcatggaaaagggatggaaatattgaggggaagatggggagcagttgtgattttataaagggtgatcatagaaggttccatggagaaggagacatttgagcaaagtcctcgtggtagggactggctagctgctcattagacaagtctactcatttctcttaattgtgcagctagctgtcatttcccagtctcccttgccattagtttggctacatgactgagttcgagccaatggagtgtgagcaaaagtgatgctcatgaatatgaagcctggctcataaccccacctccaataaccaccaccacatatgtaatattccttgttctttttcattcttatgtacaagagcacagtgattttgaaatccgtatgttaaagacatcagagccacaaaagcgaagtgccctgggcccccctgatccaccatttggaggaaatctacttgttgaccagaaaatttttgtaaagtttgcatgaacggaaagtttctattatgttaagccactgaggtgtgggcttttttttttttatagcagctttaataaagataggtaatatagaaataaagaagcgagggaggaggccatgcaaatattgcgggaaagaacgccctaagcagagaaaacaagtacaaaggccttgaggcaggagtgtagtaagaacgtcctaaaaacagcgaagaagtgaacaagaagttcagaaatggagtgaggaaaggagattactagatgtggcccaaaagccttctattcagagattctatctggaatctgaaggcttttataatccctatcccacatcgaattcagtttctgggtaaaaataaattatagagcaatatgtttgggaaatctcagactgaactgtgttctccaatgctactttaatagatccaatcaactaactgagccctaggacttccccccagatttttgtgtgtgctgtctacacagttgctgaaacaggcttcgggaaaatctgaggatgctttggatcttcatctgtcagaggcagagttacatcacctatcagtaaagcctgtcacaaagccattaccatccgatagaaaatgcaattaagagggtatgacttcaaaccgttttttctgatttgaatcccagttcagtttttcccttcgcagacattcaaacaccatcatcttcctgcctaaacgtgctcctctgtcaagttcaatggatgactccaccagctcccggttttttaagctgaaagtgtagaagtcatccttgattcttctctctccctcactcccagagcgtatcaataagcatgtcctcataagtccacttgagaaatctctcttgaatctgcccacttctctccatcctcctgtcgctgtctccttcgctccttctcattctgatttcaacttttatttttgatccaggtagtatacgtacaggtttgttacctgagtatgttgtgtgatgccaaggtttagggtaaaaatgatcccaccacacacaggtagtgagcatagtacccgataggtagtttttcaacccttgcccctctccttcctcccccttctagtagtccccaatgtctattgttttcacctttataatgagtacccaatgtttagcttctaactatcttcggttttctgttcctgcattaattcacttaggataatgacctccagctgcatccatgttcctacaaaaggcgtgactgtatgctttttatgactgtgtagtattccatggtgcatgtataccacgtttatttcattcaatccaccactggtgggcacctaggttgattccatgtctttgttactgtatagtgctgcgacgaacatgtgagtacatgtgtctctttggtagaaagattcgtgttcttttaaatatataccaagtaatgagattgctgggttgaatggcagctctcttttaagttctttgagaaattttcaaactgctctccacagtgcctaaactcatttacattcccataaacagtgtataagcattcccttttctctgaagcctcaccatcatctgttgttttttgactttttaataatagccattctgttctgatttctaacagcctctctgagactgctttctaattagctcgtgcctcctaccttgtctccttcttatccactctttacacttcagaataagagatctttctaaaatatgttgctgatcatgtcctcatatactcaacaacatcctagtgccaatgggataaaatataacttctctaacatggtcaaaaagccctttgtgatctggtctctacttctatttcttcatctttctttgcactgtatagttcatggaacaacttactcttccttaaaatccagcactatatccatatcaggattcatcatacaatgttccctctgcctgggatgtccttccatacatcttcatctaggtagctccaggttgacctttccaatctcaggttagacatcacttcctctacaaagctttccttgattaattagacatccccaacccaggtataggtcacaggtcctgttatgtagtcccacagcccctcataatgtttccatcacaggaaatactgtaatttcccatgttcatcaaactattgcagattttctatctattgtgatcgcaccctatcctcagtacttagcatatagtatttgcttagttcctatattaataatctcctaatgacatcatcttaattgtatatctccaagtaataacattatttcatagtagtctggggagattttccatgaagaacaaagtgtgtgtgtatgggaggcaggttctgtataaaattaacgaaattcaaccagggaaagctatacagcaagtgtttgtaaactatggctcatgaaccaagttgtgctcaccacctgtttttgtaaataaagttttactggaacagagctacactcattcatttacatattgtctatggttactttcatgctacaatagcagagttgagtagttgcagcaaagattgaatggcccacaaagccaaaggcatttagtatctggcactttactcaagtttaccaccatctgctatgtgataaatctccttcttagacatctactagggaattaaagatacgagagttctgatataagaaaatctgtataatctctataaaccagtggtatgcgaagtcatgaaaatatctatgataattagaactactcctcaccccttgaaacaatcatgagcactttacacaattattatttcacaggacaaatagaaaaactagacattgcatctgattataaacattaattctgtttaaattcacgaacatttccaactatgagaaactatatctacttaccttagaatcaaacatggaaaatagtcaaaagacctatgcctctgcctcacttttcttgtcttggcttttacattatgccagtttctttatatttctctttcttcctaacccacaaccaactttatcatttattttataatttcacctcttttttgttactcagttttataatttcacctcctattttgttactcaatttttttcccctctgggctttatggtgatttttattactgtgtctgtattttgaattcctcgtggtagtaattctttccacccccagaaaaaatgtcatctgttttctcaaactatgtatgtttccagtggaatatgaatacattatatagagacggaaacccgaagttccccagagagtgagagagagagagagagagagagagagagagagagagagagagagagagaaaagggaacattttgatcatcactttcatactcgagcagaaaggcaaagggtatttccgtttcacttatttaaactctgcacataattgcagctaagttcctcagaaacagaggttactattctttaaaagaatatagccacaggaggtacaaaaatagttatattccctgaaacagtatttccttaaatgtggtctggggacccctgggagtccctgagacccatgcagtggttctgtgaggtccaaattattttcgtaataatactaagatgttatttgactttttcctctctcattctattatgagtttttcagaggctacatgatgcgagatatgacagcacattcaatgcagaaacagatataagaaccagctgccttctcttaagctaacttttaaagagatttgcaaaaatgtaaaacaagatcactcttctcactatattgtttctgttgtagaagagatagtttaaaaactaaacatttattttttatttcaacatgcaattttaaaatgaattaataagtaaatattttgaacaattaccacttttttttttttttttgagacggagtctcactctgtcgcccggctggagtgcagtggtgcgatctcggctcactgcaacctctgcctcccgggttcgagcaattcttctgcttcagcctcccgagtagctgggactacaggcgcccgccaccactcctgtttgtttgttttgttttgttctgcttttttttttttttttttgtatttttaacagagacagggtttcaccatgttcaccaggatggtctcgatctcttgacctcgtgatccgcccgcctcggcctcccagagtgctgggattacaggcgtgaggcaccgcgcctggccaagataattttttttgtagaaaaataatatgtccttgtcaactggcataagtaatgacagcttatcatgcatgccgagtttgtcattataaagacctcagacaagtaaataatacaatgtaaaatgaaaattgaaataatccattaggtatgaagaaatccaccacaaacattccagttggagttcagaaatttgccaatgaatttattagagacagagggaggtgaataatgtaggccaatgactatgagggtcaacttttagagttaatgaactgcctaaatatttactgggaatctctgtgatatgctaggctaagtagggcaccttcaaatgatatacacactgctcacttacagattatatttcactgaggcaagctcgcctgtcattaacttactgtattttatcaacaaatatttgagcatctaccacataccaggtactgattttgctacttgatgaggtagttaacaaaatgttgacaggctagtcagtgatacagatacatgaatgggtctccttttttttattgtttttattttttgagatggagtctcgctctgtcacccaggctggggtgcagtggcgcgatcttggctcacagcaacctccacctcctgggttcaaacgattctcctgcctcagcctccgagtagctgggattaaaatgcgataagcattgaagtgtagctatgcattcaccaaacatttattacacatctaccaagggccaggcactatactatttttgctggatattcaggagtgaacaaaacagagccagtccatacacgtagcttatggtgtcatgggtgacatcaacattaaaccactaatcatacaaaagagtttaatgcaaaccatacatatatatagaaaaaaattaagattgttaggagagtactccttttttacaaactttcactttcagaactttcataggtatgttgctcctaaaggcaaatatgcatcaaattttactttccatgaataaatggggtcactggtcagctatagttattatagtttttggtatcatgtctaactttagactaagatgtgtctcctctgtgtgtatttttgaaatgttttctaaacattattaatctcattatgtgccatgagtacaaaagcaaagcaaatttgttgagagtcctgggaaaacatagaaaagaagcaataataacaataataatcaaggtcctcaacatttataattttctcaaagggcttaactgaatatctatcggtcttttgaatggagacatatgttctaagaacaaaagcacttacagtcatttggaatataacctgtttctaagaagagcagtggatcttacttagattgaaaaggctgtggtggttgtaacagtgagtccctctgagtaagtaacattgaaattgagccctgaaaactatgtcaatatcagccggaatacagatggtacaagacaaaggaattagcttttatcaaggtagaagaaatacttagcgagtcagaggaattgaaactaggaattcagtgtggctaaagtttagagagaaaaatggagagttgcaggagctaagtccagagaaatggacaggtaatatcttctacattacctctgggcattaaaatttgattctgcatgaactttattagtgtattatttattttacatccatgtcaattactaaattcattaaaaatttggtacaaggtacagatgaacttagggagtctacctaacagattactcaagattggttttgatccttgaagtagaccacttcacttagctaagcatccgttttaaaatactagaatccaaagggtatcttcaaggatttcttttttaaacagacctagccatgtacaatagagtcaaggcagtgtaaactaaaatatgtgttttctggttctcagatcaataggacatacagcagactgacatagcacttaggagaaaatttctctgtatgtttacgaaaactgaagggagtttttttttttttctccactgggagctgaccatcattaccttccagctgaatctatgagagaattctgttcccattctcctgaattaatagttgctaagaaaatgccacataatttatttgctatatgacttaaaaggcaaagcataatgaaaatgagagtaaaataaaaggccattaacgagaaaatattgcatatataaatttgtgtcatatatatagtaaatttgcatcataccaatatcagggagaaaagtaagattaccttgtcaagcatcaagcacaagtagctaaaccttaaatacagtggataatgaggaacactgagataccaatattttttaaagcttctatttatttattttgagacagggtctcctggggtgtggtagcatgattatagctcactgtaacctccaactcctgggctcaagaaattctcccaactcagcctcccgagcatctaggactacaggcttgcatcaccacagtcggctacatttttaattttatgtagagatggaatgttgctatgtgcccaagctggtcttgaactcctggcctcaagcaatcctcttgccttggcctcccaaagcactgagatgacaggcatgagccatgtgcccagtcaacttttaattttcatttaacagctttattaagtatttaaggtgtacacgatgggtccataattaacaaacagatcttccccgactgactacgatggtttgacttacaattttgaagttcaccatggtgcaaaagcgatacacatttagtataatcctggactgaggatggggttatatctggatatactcactgtaagttgaaaatatcattaattgaaaatgtacttttgactcataacattttcaatttatgatgggtttatcaggacacaatcccatcctaaggtgaggagcatctgtatacaatgtgatgaattgggatataagcatacaaccatgaaaccatccccataatcaaggtaaccaagtatatgcatcaactccaaaagtttgctcatgcccccttcattttttctttcttcttcttcactttctccttctccttcttcttcttcttcttatggtaggaacacttaagacatatcctcttaataataatttaagtgcacagtacaggcactatgttgtacagcagatctttagaacttatttacattatataactgaaactttatactcattgaacagcaactcccagttcccccttcgcccagcccctggttactatcattctactctctggttctacgagtttgactgtctcagacacctcatataaatggaatcattcagtatttgccctttggtgactggcttatttcacttagcataatgccttccaggttcatacatattgtcaaatatggcaggacgtccttcccttttaaggccaaataatattccctgtatgaatacaccacattttctttatccatgcattcttccatgcacagctatgctgtattgatatcttggctactgtgaataatgcttcagagaagatgagagtgcagatatctttttgagattctggttttaattctttgggatatatacccaggagtgaggttgctggatcatatggtagttctatttttaactttttcaagaacctttctactgtgttctatagcagctgcatcatttttccattaccacctatggtgtactagcgttccgatttcctcacatcctcaacaacatttcttatctcttgtttttggtttgtttttatagtagccatcctaacaggggtgagatgatagtgttcatctcacagaggttttgatttgcatttccctgatgactagtgatgctgagcaccttttcacatacctgttggccatttctatgtcttctttggagaaatatatatttaaatattttaaaaatcaagttatttgcctttttcctgttgagttgtattaacaatcagctctgtttctgtacactaacaataagctacccaataataagcttttcttctattggattatcttgtcacctttgtcatatattgattgaccataaatataagagtttattgctggactatcgagtctcttccattgtcaacattaggagtgcagttagtagatttaagaaaaaaatatgaataggtttgtttcctaaacctacaggtgatctataagcctgtccttatgacagtaccacactgtcttcatcattgcagatttacatcaagatttgaaatcaggtaatgtcctgatttcaaagtcctctaacttttttcttctttttcacaattgttttggctatttggtacatttgaattgctatatataaattgtgggatcaatttttcaatttgtgccaagattgtgcaatttttcaatttgtgccaacatctgctaagatgtcgatggagattgcattaaatctatagaacaagttggggagaatcactaccttatcagtattgagtcttccaattcatgaacatggaatatggtcccatttatttagatttttaatttctctcagcaatgtattacagttttcagagtacaggtttagtacttatattttcaaatttatgaccatttaatctattttatgctacaaagaatgaaattattttcttagtatcattttcaattttttattgctagtacacaggaatgtaatttattcttgtatattgattatcttgcaagcttcatgaacttatcagatctagcagttattttgtggatatcagatttttctacatacaggattgtattgtctgtgaataaagagagtttcatttcttcttctatactgtggatgcctcggattcctatctttctcctggacctgggtttttttgttggaaaattttaaattactaattcagtttctgtgtttgtgttaggtctattcatatgtctatttttttcttgaatcagttttgttaatttatgtctttctaagaattttttcatttaatatgttttgcagaaattgttgacaatgttgttcatgttattacattctagtctttctaatttctgtagggttggtagtaattacccctttttcctttatgattttggtaattcttttttttttggtcagtctagctaaagcttctccatgtaaaaaatattttcaaagattaatgtatggtttcattgatttttctttcttcttcttctattttattgacttctgctctaacccccgttatttccttccttatgcttccttcgagcttactgtgttcttctttttctagtttcttatggcgaaagcttgagttaatgatttaagaattttattcttttctaaaataggtatttaaaactagaagtttccctgtaagcactgctttagttacatcctataaatcttgacatgttgtgcttttatttttattcagttcaaaatattttataatttcctatgtgatttagtttttaaccaatggatttagaagttgttgaatttcaaaatattttgatatcttccaaatttccttctgttgaattccaatttaattctgacatattaagagaacataatttttatgaattcaagcctgttgagtgtattgagatttgttttttgacctagcatagaatctatcccagagaaaatttcatgtgcactttaaaataatatgtattctgctttcatttggtggcgtctcctataaatgttagttaggtcaagctggttgatagtgttggtgaattcttctatattgttgctatttttctgtctaattggcctgccagctattgagagtagggtttgaagtctccaataataattgttgaattgtctagttctcctttgaattctgtcaatttctgcatcatagaatttgggactttcctattaattatatacgtttataattgttatattttctgcttaattgaccccttatataattaaaaatgtctttttctcttgttacatattttgtcataaagtctattttgtctgacattagtattgtcacttcattttttatatgtaaacaatttgcatagtacctcttttttctttgaaattatatggttttggctctaatacatttctcttttaaacaaactatggttggatattttaaataatcctgtctgaaatctctgcctataattggaatgcttagttcactcccatttactataactattgatatgtaggttgagtatcccatatccaaaatgcttgggattggaagtgttttggattttggatttctttagattttgtaatatttgcatatacctaatatcttggagataggacctaagtttaaacacacatactatatatatacatatatatatatatatatgtgtatatatatatatatgtatatatatatatatgtatatatatatatcttaatagatatcttatacatataacctggaggtaattttataaagtatcttaaataattttttgcatgaaacaaagttttggctgtgttttgactgtgactcattacaggtcaggtgtgaaattttccacttgtggtattatatcaaccttcagaaagtttcacattttagagcatttcaaatttcagatttttttaatgggaattctcaacttttagttgcaattacatgtgccatattgtattttttcacatcttattcatgtcttttttgttcctgtttctcctttactgcactgtcttgttagttatttttagtgtgtaattttaaattttgtttttaactatttattttcttagtgcttgctctaaagattacatatgcatcttaattgatcataatttacttaagttcaaactaatttaacacagtaaaatttagatatttttctctgctaagctccatttttgctcctcctgcttataaacacaataacacaatgttataatttttatgcaatcttaggtcttttaaagaagttaaaagaagaaaaacatatatctatatttgtacagtcttttatatgtatctacatatttatcagttctgtgattctttatctcttcatttgggttcgagttactgaatatcacttcttttcagcctgaatgactttatttagttttttcttgtaagtcaggtcagctagcaagaaatattctcattctcaacttggtaatatatttattttacctatatttttgaaggatagttttgttttatgcggaattcttggttggcaattttgtgttctctgagaactctgaatatgtcatttcaatacctctggcctctattgtttatgatgagaaattaactatcaatcatgtgatccctgtacatgaggagtcatttttttctggttgttttaaagactttcccatttgtctttcaataatttcaaatgaaactatttcaatagtttgactcttatgttttagggtattgatctcttcgtgtttattctatttggggtttgttgagcttaaccgtatttgtgaagtgtttggccattatttcttcaaataatttttctgcctctttaacaacattctctttttttctggaactcttgtaacatctacattgatatgctcaatgttttgacacaaagctatgactcatgttcgttttttatactgttttacctctgacattcagattggataatttttatttatctattttcaaatttactgatttttttttttttctgtcttactatctgctcttgagccccattagtgatttttttaaattttggttattctactttccaattctagaattttcatttggttcttttatatagtgtgtatcttttagttgagattctctatttgtagttattgttaccatactttcatttaattatttaaacatgcttttcttcagttgtttgaaggtatttatagtaggagcctttaagtctctatctgccaatacctgggccaattcagagacaacttttgttgactgcttttccccatgagaatgggtcacagttgaacgtatcgtaaatttttcttgaaaatttgacattttaaataacatattaaaggagccccaaattctgatgttccttcttatgcccagcgttttttaaattgaagttttaataacttgcctagatgaaatctgtggaatctgtttccccacagtgtgtggctgttgatattctttctctgtcaaacaacagaaacaaactgtatgcctagtttcctagaggtaagcatagcttaatttgcattagtcaatagttggccagcagttgatcttaaatacctcaagccagtaagacttccaagttttgctaaaggttctttatatgtgttaaagggtatattcaacatgcaggcacattttaagttttcatgaaggagacacaaggagtccttactgaggcctattacggctgcctcattttgcagatatgctggttaaattaaatttctggccagtctgccagtcagttacttgttccaatcaagactgcaactttaggccagctgagttgctattctgcctttttgtttgccgcctaggtctccaccgttactgacaatgcttctggacatggagttttaaacttctgcttcaaataaaatcagtccctgtggtgatgaagctgcttatttccatggcttgttctaccttgatagaactattatgcttgaccaagctgggagtggggactgggggcaatacaggcaaatacaccacaaattcatattgttcatatacaaagtttagtactttttataaataatcactttttaatttagcatatgccgttggttgatatccagggtcataagatgttttctccagtgtgtcccattttactgattcttggggagatttatcgagctactcactttatcatccccagaagtcatgtacccagacactaacttctaagcacctactcatgtgctgggcatagagctagccaatttatttacattacctcttactcttacaacatctctataaatatgtactattatctttatttttggattagtaaaaggaagctcagataatttaagtagctggtgcaagagaaaaaagaacaaattaaaaatataaacgcaaagataccatgttacatacttccaaaggtaataaacacaggtgggaagataggtgattattacccagcatttagttgccaggtttatgtaatggccaacctgaagtccaagtactctgatttactactgcctagtataaaggctaattagcaagaaaacaccaaataagtcagtaggagaaacaagctgtttttgtcatggatagactctaatcattaaaaaaacaatcattatattggctcataaagttagaatttgattcgcacatgtaattctaataaaatccagggtcccacgtgacccatattcgttaaagagttacaccaacagagaatcagcccagcaaaaatagatcatcaaaaaataattataatctcaatttacattttaaaattaatatagggaactcatctacaatttacagaacattccagaactttcatttcttctcctcctcacttttttttatacccatccagttcttcacaatctttcaacctctgaaacactccagaaaccgtatccacattcacagattctcttgttatctttatggggtagataaaccttgcttttgtagatactttccttttacacaatcgtcatttttccttaagtattctccaaattccacaccatttaaaatttataggatgaatggataaagaaaatgtgatatatatatatgcaccatgggatattattcagccatacaaagggtgaaatcctgtcatttgcagcaacgtggatagaactggaggtaattattttaagtaaggtaaaccaggcacagaaagacaaatattatgtgttgtcactcacatgtgggagctaaaaacatggatctcatgaaagtagacactaccttggtggttaccagagatcagaaataggagtagggagaggggacaaaggggaaaaataacataaatttacttattaccactgaactgtatacttaaaaatggtaaaggtatatttacttttatttatatagaggtatattttacctcaataaaattaaatttaaaaaattcaggccaatcacattggctcatgcctgtaatccccgcactttgggaggctgaggtgggtggatcacttgacctcaggagtttgagaccaggtgggcaacacagtgaaatcctgcctctaccaaaaaaaaaaaaaaaaaaaagaaatagctgggtgtagtagcccgtgtctgtggtcccagctactcaggaggctgaggttggaggatcgcttgaacctgggagatcaaggctgcagtgaactgtgatcatgccactgcattccagcctgagtgacagagccagaaccccatctcaaaaaagaaagttcataaaagcatatcaaatatagtacttttccttagacataagaggaagcacatatctgagaagacacaggcttgaagctgttaaactggcaaataatcataaatgtagtggggaatattcactttcttatttgttctaccctgtcgtcactattagctgctttgttcacatagctagatatggtcatatgtaacaataagggaaaaggcacagatctgggtctaaatcactgacttttagttctcgatccttctataactttggttagccttggacatatatcttgttttttcttgtgcttaatgtggtaatttgtaaaatggacataagaatgctgccatgctttgcttatgatctcgaagagtcaggtgagatgatggacgtataaaatctctataactgagatattgcgacaattaagtgggaaacatttgtaaaactcttatcaaagtcctgttcatagagtaaatgcacaaaacttagtgtcattaatactagctcttgtaacttccaaatttatagtttgggtacatgaatagatagtgatatcacccacagtagattttgggagaggaatataacatgttgagttttggatatactgactttgagatggctttgagacatagaagaggaaatggtccatttgaagctacatatgtaggtctaatctgaaactatatattgggccaaatattagacttaggccataaaatgaaatcggtgactttggtagagactgcttagctgcttagcccatgatccattccactacattttgaatgcccattgcagtttggcattgtcatgagaataaattctggccaatgacatacaagctaaagtgttgtgtagatcttccatgaagtccctttaaaagggtagaggtatcccttttttgtccacttcctacaccttgcagcctttgaaaagcagttgtgatagatagagagctgatagtcatcttgatccatgagtgtaaggacctcaccaaaggatggcagatctgtgagacagaagggatctggatcttcaacatcatagagcaatgataccaacctcggactacctactggcagattccttctacaagaagatgaatatatttctactttgtttcagttactataattcttttttaatctccctagatattattctaattgatacagtgaaagctacatttgttgctatggataacaatcagggaaaccgtatagaatgagaagaagggagggttcagaacatgtcctagagaaacatcaggatgtaaggggcaggtaaagcaaggagtgtcatcaatatagtaaggaattacatagagaggtaagaataaattcagataagattagtgacttggaagataagataggaccaagtgctaatacggaaagtgttcagttaatggcacatggcctacggataataggactaagatatgtccagtggatttaactacaagaaatcattgttgttattggcaataatggtttctgagcagtggtttggatcaaaagcaaacagcaaaagagaggagagggaaatgtgataatagagaatgtgtgtttaagtaacagtgactaactatgaagaagattcaaatgggaataataacaagaaaggggaagtaagagacatttgttaactttggttgcccagaatctgaatgccctgattatgtcgaacaaaatccccaaatacaaatggaatctgatgggggaagttcagtttttgaatctggaatgagtgacagaattataaggcactatctagaattctttccagtagcaatgacattcttcacccagtgtctgcagtggtagagtggtgcatggcaacgtttacatctagtgtatgggggccagacgtcgtggcacatgcctgtaatcccagcactgtgggaggctaagatgagtggatcgcttgagtccaagagttcgagatccaatctagggtatgatttggactatagttcttggagctgagcctcttttttgagttctgcccattttgagctggttttctatccctttgtttaggaatgggaacaggtctgtatctttctcctaaagtccgtttccgcttctatcaacaaaaactgggttctgttattcacagctatgaactctgacaagtacagtggaatgaatgcatttggaaaggaatgtctgaatatatttatattgtaatctaggagctaaaaacattcacctgatcagggatagtgaggcagcagaaaaagggtaaagatatgcttgtgtttgtgtgcattcaagagacagaataattaaccggggcaagattcctctgaaatgagagataaggctttctgctgaatataaggattgttatacattcaccatcataatggtaaatgataaattgttagattggcagcttacacaaatatagtactttcattttacaaacgatttttaaaaacatttatcatagtagagagagataaaataaaatattttaattcaaattaacctttgtagaaaaaatcacattataataaatttagacttatattaatggtcaaactatgacaacatataattagtaaaacaaaagagaattttaaagggaacatgataatagacttattatacatatctaagacatccattaactatattaaaccaaggtaaggaatcaataaaatgatcaacacatttttctcttaggactttgggttttcttttgtaaacaaaggtaggacactcacctgaggatagtgtattccttttttggagtgttatgatttgtgattctaacataaaaagaactttgtaaataagtgtttctaattataaaatgtgtctcaaaggacaggctttgagggtagacaattcaagtttcttcagcaacaaggaaaataaatgcagaatgccatttggcctgttttttttttttttttttttttttaaaaatggtacagtcttggtgcagctgctgttgggtccaatcaacagatagactttaaatgcaataaccttaaagggagagagaatttacagcaacccaagtaaggagtctgactggggcatgtatttctttgtgtttccttttcatgttatgggctctgtagctacccttgtattgaccatttgcagtatattcaaataaatgctgtattcatactttaaatatacatatgggcatctactctttccctagggtgccccaaataaaaagggctcatttcttatctgcaatctgtaggatgaaatctttgaacttattttcctgtatgttgtggtaggttttccctgatttatccccaatattttgtttgtcaacccttctgatttgtgatagtttacagtggtactctgtggccccataaagatcacccatatcactttggttcatttgtcaccactagtgctcatctgccacgttggcttcctgacacctgaactccttttccacagcagtgcttaatggttaatgtgtactctgggaattctggtttgtttactggttagcaaattaatgacttgagaaaggtaccttattgagaagcagttagttcaatggagattgccaccatctctacattgacagcaaaatggctcagtgtcttcagcccttgtcttcctcctgatgttcagacttacctattcaaatgcgtgttttctgatcaccttattttcaatgttccaagagctccttaagactattatatcccaagttgagctctgtatgtctgatttgctttcctctttccattcagttactctcctttgtatttcctatcctgactaacagccttccatgcagccagttcccccaagcaaaaaacctggaaaagggatcatcctagaattgtcccttcattcccctcatcatcccatctacttaacgactaaattgttccactttcatcaagtatttcttgaatctgtcaggtttttaaagttctattctgcttactcattgtctctaacttgagtcaccctgccactagtttcactctctttttttcactctgagctcaactgtcaaagggacatatgaggatgcaaatctaaagcatataaaaacgtcccaacatccttatattctaccctggaaaaaattctttgagatttcaaatcttccatgacctggtccatcttgacaatttcatttgtcatggcgtcatttttcagccttcctacatataaaaggaagtccccttatcaaacttgattagggtaagtggataggcggtttttggaaaaatattgtaaaattggagggattatataaatgtgtttacacatcttcaaacattttatttttcttagaatatacaagtggtcactcatttacttctcatttggtatggggtccgagacttttcctggagtaaaagcccacaggttgaagttaagcatattactttttgcataaaacacttctacatttcataatctgtgacttttagtttggtttctttgaattacagtcagatttggagatgctgaaaataatctcaatgcaaaatacctccattttttggggattctatccctcatacccaatcttaaacagttgtcttacctacatctaattcaacagcaccgtggttttttttttttttttttttttcctcactctgtcacccaggctggagtgcaatggcatgatcttgtctcactgcaacctccgcctcccgggttcgagcaactctcccacctcagactcccatgtagctgggactacaggcccacgtctggctaagttttgtattttcttagtagcgatgtggtttcgccatgttggccaggctggtctcgaaatcctgacctcaggtgatccacccatctcggcctcccaaagtgctgggattataggtgtgagccaccgcatctggccttttttttttttctaatcacctttatcaagtcttccaaagcattcaatttagtattcatagaaaccacaattctcttatcttttcatttctatttcattagttttcatgatatttaattaaataggacaattttaataataagaataacttgcatagccaggtcaggaaccacagactgttgcctcttggagaacatactctcaaatggtgggagccaaggtacatggtaccagaaaggatacttgaacacctttcaaaaacatcaataggttactaatatccatcaataggtttggagtgggaattgggcagtttatatgtagaaaatgaagagtttagggtaagtcaatggtgcttgcttaacagagcctttttatactgaactgtgtatagtccttcaatgtaggccattttttcttgcttcagtgattttgctcctgtcactttttctctctggcatgtccatttactcttcatttgcctcttctcatcctttaagacccatcccagagatcacgttccctaacaaactctccctaactcctactttcccaggcacataaagttcatggaaggccacaaataaagtacattcacttgtatatctccacacagtggtatcatcattaccagccaatgcaacaacatatttggtgccagctagtctgtttcactagaactagccaagttgaaaaaataaaatatgacataaaacaattaactatgaagctgatttttcatagtcttttgatgaagaattatgaatgcccttgaaagcttttcaagagtcatcagagaacagatgggaagagaccagcttttccattgacacctgtgaataataatatctgtatgattctctctgatcaatctaaaaatagctctttggtgatatggattgcatctaaaacatcttgtggctatatgtaggatgaggctaaaacattcagtttcagggctaattcctgcttaattcacttaaaaggtattagttgagatacagtgagagtaggataaacaaatgtacaaaatgtttgaatcaaagagctgctttttgccataactagctaaataaattgaagttacttgtctcttaaatgtactaaattctgaagaatacctaaaatattattaaccaaactccttccatttttttaagactagaagggatcaaggtcaatttctagaattgcaaacgtatccatggaaatgtgataacatgataaaaacagaaaaattggtctggctctttagatctatttttaatctatataataatgtcaagtgtaaagatttaaatcttcagtttaatctgaatgtgaataaaattcttacgatttaaattaagaaagtacttactggccatctacaatatatcaggctttctggtaagtactgtgggttatagagataacaataagagagtcctctgccctcatgaagcttttaatcttgctgggggaaaagcatatgtaaataggtatgatacatgatatatacatacaatattacatgagtgttataaaaaggggcaagaaaaccttaagagaataaactgcttatgtttgagaagagcaggtcacaattcattgaggtaatagcagttaagatgagtcttaagggatgtgtaagattttgggaaaaaaaataaggggaaagagaattcaaccaaaggaagcggtttttttttttttttgtcttgttttttgttctttgtttttttttttttgcaaaagctgaagaacagaaaacttcaggtcattcaaagcttcagacataaacagaaatagtggaaattatgaaaaacagggttggaaagataggtcagaacagattctatgttcaattcttttgctactacgtgtggccatcaaaggtaaggagaaggttggtaggaagaaattgcaagtgtataccagagaatcctgatggacaaaactgggataaataatgcaaaatctgatctagagtaaggactccggaggcagactgcgggactgcatcctggttcaaatacttgctggctgtgcaatcttgggcaaagagttttatcagtctgtgccttcgttgccctcctgtaaaattaaaaggagaatagcaactatttcatagagttgttataagtattgagctacgtaaaacacttggaacagtgcatggcaatattaagtgttatcaccatcacttccatcaccaccctaaccgtcatcatcatacaaaggtctgcatgaggtactataaaatcaaatatctatggaaaagcaattaatataaatgagcaaagtgggacaggtgctgcaaactgaggacaaagcttgcttaccccaggcaatgcttctcaaactttaatgtgcccatgaatcacttggaaacttggaaatcttattaaaaatgctgactgttatttattagattctgcatttcttagcaactcccaggtgatgtctgtgctctggaccagagaccacactttgagtagcaagaaaatgaaacatctgttactcagttgtaggtgatggtgccaagagaaaatatagtaatgagtgcctagtagccagatctaaattttcaaaagaagacagaaatccatatttttttaaaaaatgaggtctctcaatttttaaaagttgtcaattatttaaaaacagtggctatgcaaaaatactgcatgcattcaggattcagcctgtgggtactcagtttccaaactctgggctggatggagagtcaaggtctaaactggcaatgagaaaaaaaggaagtttgagtacagagcaagcggacgggacagatcctgggggcaaaatgtgaatgtgtgagcaggcttgtagcactggttcacacggatatactgggtacatttaacatattgcacacactgtaaagagccatttgagtcattaaaatattcgcttttaatttgtaggaaataagatgctgaaaagctatttggttgaaagctatttggttgggggtggggtctgaatttgtaagaagccaaagttaaagaaaacttaagagacaacagttgtcttacaaggaagcgcatagagcaatatgaattgctaatggagactttcaagaagaggaccaaccaggcctactttaatgaattagataaggctcatttctaatcaacagcgtgtatttgcatgcaaacaatgagctaaggtctttaaacaataatttcttcctttaagtacatttacgaatgcctcccattatcttatttacaccattaatttgcatggcaaaccagcatagattatatactagtacattttggtttaagaattcagaagtagagaggtttaaaggagtagtaacttaatgaccgtacatgaagtctcacacaagaagggctttttaacatgtctagacttacttttaacttccatgtattctgaaagagatttgtcaagaatcatttccaaggtaatctgaaaatattatctcctttgggactgcttgccagaaaggtgcacacattccattgagaaggggctactacccagatgtacgtttctacgtactattcacctctaaaagtaaccagagttccttgaaaaaaatgggtaattctaaatctgggataggcaaagtccaaggtgagcctgggacaattgagcaggaagctctgggcaagaataataactgtaattcataataatatattgaataaataaaaatttatgagtccattttgacataaatatagaggaaaaaccttttttttttttttttttcaaacagaagaaagccagctggtaaatgttaagatcatgtcagattaggaaaacctccattttgcaagccccagtgtaataactgagttagggaaggatcatcaatggatactaaagccattagatgatttattaattgcgaagaaaaaatgtgacattataatgcaagatctgtcagtcaccacctgaagcaagtaataaaactttgcagcatttagtgagactacttcatatgatgcacctcctgatgtgacgtaatacaaaatacacagcatctcatatgaagtattctcgccaaacatgtttgacatgcatctcttgaagtcttatttagacctaacttccagtttactagaaattcagagactacagaacaagttaaatcatcccatcaggggaaaaaaaataaaacaaatcctgaaagatgagacattttttgaggctagcgtcctggacattttcaaatttcaatatcggtgaaaaaaatgtggaagggctattttagactaagaaggatgaaaaataataataaccaaatgtaatgcatgagccatgataagatattggtactaactcccctgcaaaatataaaagacatttttgaactattaaggaaatatgaatatggaatggatattaacaataatgcagtattatatttaatttggaggagagcataataaacaggcatggttatatatggcatgtctgtatttcaaagcgacacatgctgaattatttaggggtaaaatataatggtatttataacttatttgcaaaaatgttaaaaagtgtgtgtgtgtgtgtgtgtgtgtgtgtgtgatgccctatatatgagagatacagaaagagggtagagaaagcgagagaaaaaaagcatatatggcaaaatgttaacaattgttgactctaagaatttagggggaggaaaacagtgtaaatgggcatatgttttgcaattgtttcaatttttctatatgtttgaaatttttcacaaaaagacttggggaaggaaaaaattcaaaattattttcattaaggtaacacttaaattaaaaccactattccttaatgcatattagtagaataattgccttatctgtgatatgggataagcaatatcagacttgtctaaaagaagaaagaattataatgttttgaaatcttaattattattgctaaggattatgattcagaggttcctcaatttaggaattccacttcccactgccttgcttccgtctcccattcaaacttttatcaactgacattattctaagtaaaatcctcttcattatgttgtcagcaatccattgcttgaaggcctggctccccagaacccctcgactggtatgtcttctcctagaatactccagaagaaaaggagtgtatgaagatagtgactgcacattaaaatgactgaaaccatagtaaattaggatgagattctgggcagataaacagacagctggctaggatcatttttttatgccttggacttctttggcaatctgttgaagcctgacattcctcagaataatgttttaaagcccaacaataagaccctgtagcacatataataagtactgcagttttgaagtagtgataagcataaatgatattttgatatatttattataactgtaatgagatgtgtacatatctgtgacttcataggtactgattgtactactgtgatttttttgcctactttcaaaatgaaaaggaatgcttaatttcagttagaggttagtaaagacaaataggtaattttcttctccagtgaagagcatggcgccccttgctattcatggacgcttgcttaaagacttgtacacaggcttgctttgtatcaacctatgacttccccttacagccgatgataggtttttatttgcacctccttcgtgtacaaagacagttttggtggctacgccatcattaaactcattattatcatgcttaagcctatagatgtatccagttcttctgttacataattgaagctgtagtgaattgtctatcttaaactgcatcgctaactgactacatttcacacttcatttgcttccaacatagactaaccttcttggatgtccactattatttgaacttttgagattttttttcctatttctaatatcttaaaatttcagaagacttaaagttttgcaactacagggctccatatagacatctagcttgaatttatacactttctttcattgatgtccctggactaaaaaatgttaaatatttctaaccgctgtacttaaagtccattacaaacgaagactactgttgttaagttgaataggcatcttatatatttttcaccggtgcaataaataacttctattcccttctaacatctgcttgcgttgcactgagagtacactattgattagcaataggttcgtgattacagcccttctataattaattgttaggttaacatattattcataaaatattattttattaatttttacttgatttgctactggatgcttagaaatagctatgagtatattggtagaaccagtacttatattttattacatttttacatttcataaaatttaagtgatataaaaatcctgaggaagtatgccacaaaagtggtctcagtggaaatttaaatatgttaacatttatttttaaaatgtagcgtgaaatagacaactttaaaagctcagcttaaaaaaaaaactcaaggaagctgaacttgactttttaaagcactgaagtgcaatatttaatgtaggtcaacatgtttaaatgggaaaatttttttcctaattacagccaaatccctagctgtaattaacttaaaatttgtatactatttcacaacagagtcagcatataccactttcttataaaattagaaagatctaaaattttagagcttatttggtgaaacaggcatattgctacatctttgtttataaattataatgtgcctttagagcccaataacagataacaagattttgaaaattcaggtgaattagagttatcagagggaatgttaatacactctattcaaatactatatgagtaagacatttaaaataggaaacaatactttatatattatagaaaaataatcttccagtcgatttaatccactttatgaattctctccgtatatatatatttatagtatggtattcaatttttttaattttctcatttcttaccatcttaatttggattagattgagcctagttcagaaatgacattatacaggtttatacctgttcatagtataagcacatcagttatctaaataataaaatacttgtatgattaagagaagaatttcaatctgggaaaaaagtatatgacttacctaaggaagtagtttaactacaaagtttagttctttattttatctatctataatcaagaagattttcaaaaccaagacttaattattcaaaatatcttttgatgaggctataattctttaactttggcaaggggtgtgtgtgtgtgtgtgtgtgtgtgtgtgtgtgtgtgtgtgtgtgtgtgtgtgtgtgtttaggtcaactaatgtgtttattttgtacaaaatatgaattgtatctactttctgaataatgtaacatgaataaagagggaaagaggaggtgggcaaagacaactgacataattccaaaatcttctttttaatacatcttaacgaaagatattcatcaatgagttgttctagcttcctgaatattaaaatccacctattatgtggatgatgggtgggatgcaagagcttggcaaaagaacgaagttttcattgttcataacaatagtctcatttggtaaataaaggccaagtcttcctttacgaaacaagacacattaacatcaacaactggaagcataatacaaaatcccatttataaactctctaggctttccaactgcagcagcacgcatttggctttctgtgccttcaatacattccaagggaaatttaaatgatgattgaatttgacagtaacctttttgaggttttgttttccccattaaacttgtacctctttggctcaagttccccttcaagaatgtattcacaaatgtggtgaaactagaggtaagtgacactatcactttttttagcttcatagtcatattcatagctatttttaaaactaagcaaagatctgtctttcctacaaaacaatcatttataattgctttctaaaatcttcttgaaaaacaactgagattcagcttgttgaagttaaaatatattgaagatattcacctttaagcaatcatgggtgatttttaaagcaaacttcaagtttaaaatagcagaaaaccactaactagccacaagtatatattttagtatatgaaaaaaagaaataaaaaatttctttactgctgttgattaatggttgataggttctttaatgttagtgcctttcaccctgcttataatctctcatgaaatattcttctaaagaaagcttaaaaagtctgctaaaatgttttcattcctattagatctgtcgccctacctcttttttctgtctgacagctgtttgcagacctcctgccaccgcagattcaggcttcccaatttttcctgtagaatactggcatctgtttttgaggattgctgaattatttcttccccagttgcattcaatgttctgacaacagtttgccgctgcccaatgccatcctggagttcctgtaagataccaaaaaggcaaaacaaaaatgaagccccatgtctttttatttgagaaaagattaaacagtgtgctaccacatgcagttgtactggcaaagaaagaaatacaaaagctccatgtgaaaatttccctatgaaactgacatgcccatatccaaaggatacaagacagaaagacaccttttatgtgtcagggaaaaaagcaccctctcggttagctccagtttttatttttgtaagcttgtcagctagaggatgttataatgtcctacaaatcaattagttggaaaccttttcaagagcaaattcgatttcttgtccccacaaggatgttccatgtttaatagtctatgaaatgttgtaaaatttaaacatgaacaaagtatttgggtttcttagtgatcgtggatacgagaggtgaaaaagaacaaacataggttagtcacagtattaaaaaaaaactctagagatatttaaataaaattaattgctatattagaagaaaattcatttcaaattctgtctgcgtcaatgtattttgcattagaagccacaaaaaactgagaattaattgctttcaggagcatcccatcaagatatccctaagctacagtaataaattttaaaataatctatagtcaccagagcatttttatgattgtcaagcttaaatattgtttacttttttcctgaatgaaattttaagagtaaagtatcagaaaaatagctcaattgaaaaggagaatattacaaccaagtacacacaaaaacaaaaatgctttttaccattaaataaaaatggcaattacgttctatttaactttttaaaaaagataatctagaatttgtaaggccattaaaataacatattaactaaatacgaaccttagaaaatgaaataatatctgagaacttgaggtacctaccgtatttaaatctgaatgactcaaatccttatgtcactgacagaataatgtgcgtatgtagaaaactctcctaatagatgtgattcatattctctaatatttttgtattctcctactccttgacacaatagcaagctgacagtagaccccagtacatgcttcctaaatgaaggaaggaatgcatgttttctgagactgaggtaaagctcccttagactctcgtttcacatacatttcttggcttttttctttttctacattcaagcaaaattattttcgaatactggaaattttggtagcatacagttagcaattaaaatactctgtaaatcagcaaaccggtgacacggtgcctcacaatgaatataaaactatgcacagttactgaactattcacaagctgtcctggccatactctcttgaatgcccatgagatgtgctctagtaaacatgtgatatttccttgtaactagttggctttgctccattgcttacatctcactctttaccacctgttcagatcagcgttgcatgtgacagtcattgcttagtaatagagacaccagtcataacaaactgtgtctatatattaggttggtgcaaaagtaatcacggtttatgccattacttttatatcataaattctttgaggtcagatattgtgtcttattcatgatagtttcctattgtttagtacaatgtctgatgcatggaaggtttcagtaagcatttgctgagtgaacgcatgaatctatgaataagggaagtggggaagaagcggagggaggaagagaggaaggaatggaggaagaaaagaagggaggaaaggagagaggtagaaagaaaggaagggaggaagttcaggctcatcatcaccatggagtcattagtattaatacccattactgatcctcctagagattcaaataaataagcacaattttctaggtcttaggcagtacataatctagttgaaaaaataagacacagttgcaagtgataatttgttatactacatacagtaggataaaaaaaaagcaaggtgatcaacaaatggtaggccagaagagggatgatctcagtgaaaaggatgagcggaggagacttctgggtcaatttggaatttaaagaatcgtagaacttaggcatatggagggttagaggcagtgagagtacggcagaagttaaagcctgtggtgtgcaatctccatgatgtgaccaagagcataaaactgggctctatgccactgtatgagagcaggcgttaggggaggagtacagccctcggtgtatattggggcctgggcagagaacttgaggcaacgtaaattattaaggcaacatgaactattacatgagaatcaccattgttttggaataaactgcatcgtgcaagcatcagtgactactgaaatgggaaaaaaattttgcctaaaacatagatgtcagggaggtatttagagagtaaagaccatggctcttatttgttccttcaagagtgtccaatacttacaactattacttcatacttttaaaaaatgcatgggcacacatcagatgtataccatagcggtgcttcctagactttaatgcgcatacaaatctcctggagatcttactaaactgcaagttctgctgcattaggtccgtggaggcaccaaaattctgcatttcctacaaacttcaaaaaaatgccaatactgctggtccaggaatacctctttgagttgtaaggtaatggagtaaatgccttttgagtctttgttaagcaatcaaggaattcttattgctgcttataatgctataaactaatgctgcagcatttttatctcagcctctttgctttgtagttttgatcttggcacttttgcttcatggctgatggctacggtgacttttacaacctaattgtggaatcagcaatggttttattatttcggtttcccaaataagagatagaattgaacagctaagagtgaagcaataatttaaaattgttagatctaaatctcatttgtatagaatcgcaaatcagggctttcaggtttttttaattttgtgaaagaagagctcattacacagtctactgcatttgtatgagaaggttttgcaaccaggagaaatatttacagtgcatggcctgctcaaggagagttttcagtgataaagcataagaaagaaaaataagggatcaaaacagaaagtagtagcttgtatgtggtgttttctgagctggaaaagataacactgggtttacaaaattaaatgtaaaatctcaatcaactttattcacacagtgaacaacattaattaattttaattctatagcttctaaatattttaagtactgaattattcattaccaataaaatttccaagctttgatatcatattaatgtactgctgtcataggcattcttatctatttctctggcaattaacatctagtcttggttctggacaaaaagaaaatcataattaaatctgttggattattcatcatagttagaaagcttattgtgttttgattccaatattaagcattcattcttaataagaagtgcatatctaactcccgtggggagcttttcaaaatataaaagcccagaattccattctaagtctactgaatcagaatttctggggacaaaggtatatgaaagagatacactaaaaaagaaaggggaggttacaaacatgtgcagagagttgggaagcaggaaggacatgtagaattactatattattttcaacttctcttctgctttttaagtcaaaagctgttcctaaattatagaaaataacactgttacatatctaagtccttcaagtctggtcaaattgggggaaggaaagaggaaacataggcaaagaaagaactgctacatttttatttttatacagggaaggatataagaaaaagaaaccactaccttttctatgaaaacattacgtacatttttttaaaagtctatttgtaaaactttccaaaactgcatgaaaacacaatagatgaaaaatagaatgtgacaaatgaagaaaaggaataagctaagaagcagttataagaaattgtacaatgacagattggatgaattatgtaggaaataaaaaattggcaaaaaatcacaaactagggagcaagataaaaaaacagaagagataaaatgcaactggaagaaaagataaatacagggaaatagagggaagaaaaaggaaacttcattgaacaaggagatgtttcaagaatccaatactgagatttacttgtaattttgttcatgaattattttgagacaggtaaatcattaaccgagtttactgattggtcaagagaaaagatgtaataaaatgaaatttgggagagttgtgaaacagacttttatggtgcaatttcctacaaatatggtgctttatcttgtttttttatcctaaggtcattctcattgtgtctcttcgtcagtgccaagaattcaggagtttgatatacagtttctgatacttttttcaatgataaataaagcaagttaaccagtcatgctaattattagaaaatatagccaatactgttttcagagattttaatgtgcttcagcaagtttctttcaacttctatcggatgatggatttttgtaaagaagcaaaataaatgcacaaatactcaaggcatatgctaagcacagcaccaggacccattcaacttagcctgtccatagactgagggattccgtcttggtggaaggtctgataaccttgtgggagcacctgaggatagtcagaacaattgaaagatggctaaaattggggaaatctagcagttaggaaaatggagagaagggcaaaatagtatagaaaaaaaaaagagtggaaaaatagtatagaaaagcaactaggaaggataagaaaacagtgaaaaatggctgaaataaatggcctttttttgagtaaagaaagaatgaaagttataggaggtaagaatcaaggtcaaggagagctcagaatgagaaggacaagaatccagtccatatatgaagtataagataatatccaaacatgttagtacaacagggagcatggaaaggaccatcctcctcttctccccactgccttctcggctccgtctcctgccgcttctcctcctcactttcaagcttagctccaatgcccagtaaaactgagtaactttctacttccttgacgatactgttaagttgtataggacaaattcgttactcatctttaatagttagcataaaagtaccctctttctagaggacttttaagaggcctaggggaactaagtgcccctcctttgtataggtatttataaaatgtttccatttgtgtcattctcatatgttttggactttacagctgaatattaagcatgaccgaatgagggctttcttctcttgaacagaaaatacatctctaaatttgaacggcactacagattcaacttttaactaaggacctccagatcttttattagtaatttgcaaggaactcagtcaaataaaaaggtcctgtcttgtgctattcacaatagcaaagacatggaatccatctagttgtgaaacaatggtagattggataaagaaaatgtggtacatatacaccatgaaatactacatagtcataaaaagaatgaaatcatgtcctttgcggaagcacggatgcagttggaggccataatcataagcaaattaacgcaggaacaggaaaaacaaacactatatgttctcacttataagtgggagctaaacatagagcatatatggacgtaaatatgcgaacaacagataccgcggactagtagatgtgggaaggagggagggtgcgcattggttgaaaaactactcatcaggtaggtactatgctcactgtttgggtgatgagatctgtaccccaaacctcagcatcatgcgctattcccctgtgacaagcctgtacatgtaccctctgtatataaaataaaatttgattattttaaaaaggagcagtctttacaatgaacgatcagaaataaaatgcacctttttagcctcttctttctcctgttatctttttttttttcaatttcagtaaacatttattgtaccttactaatacaaatgctgaaaccatacaaatgtgtgtgttcatttgttacaggaactagagtcaggagcaggccttgttagatttcatttaatactctctttttcctgtgaggtataatagtagatatgctcttggtacaatttcccatctgctcctgataatggttgctataaaagaataatgagaattccttctaaaactagaaatagactgtttattttccaaagcaaacatcctgccaatgaactgaaggaaaattatgtacagtagcaatttattttaatgggacatttacctaatatcaaattgtaatgaaatttccttttgatgtatttatcttattcatatcaattatatatatatatatagatttgttattatcactgctattaatgtgtataccaaaattaattcatcataaagagctttaagtactacatgttttgtaagggtatcttgggttgtttttctttctcttccaagaaatgctgccctgggccaaaaagaaaaaatcacgtgctcctcaatttcaagcagagattcaatacagtgttacctaaagtgaggaaaatataaatatgttaagtttttgccctctgaaactgagggctacattttaaatctggtcccagacatgttttggcgttagaactttgtttgattaatgatttgaatgcctttaggtggggcatgaaagcattcaatcattctgtaaaggcatttgaattggtggctcttgttttaaagaaaactgttgttacaaagtacagaacagaactttgcaaagcgaataggttttagtttgctaaaataaatgttagctctctctacgttcaaggatttatttaatccttctcgccttctaactcattcatgagaacttcaggacaaatagaaaacatttaagggctgtgtttttctctccatttacttagatttgcaaagaaaacaaattggcctttccctgataaaaaggcatcttgtccacagctgtacttgttttcttattaagtgatcctggttatagaacatgtgacttcaggcataaaattctttctacatgattactagcatgcctctgaacacattaaatgtttcatcgtggaacatattgcacgtaactcaaaaaacactgtctcaggacgtgatattcgaaaggaagcataggtcattttaaaatttctaatttctcttctctctagaggtattatcaatttggagccacataaatacttcttcaaaagccatttggcgggtagagggtgatacaatatgtatgtgtgcatatagaaaaagccaacaaaattgtttttcaaaaataagacaatgtgcaagtcaacttgattatacactgtaaatatttgatggaagtatctaatgtcattggttctaaaaccctgtagttctctactggtatttgccatgcctatattttcactctgtaagtcaattattgattggatacctcctattagccagacactgtggaaggtgctagtcatcattctctgctggaggatgaatggattggaggagcccgggaatagaagtaaggagaccaagcaggagatatcatggtagttaaagtgaggaaagatggtcgcttggattgaggaggagtcagtggcagaaatggagagaagtgcatggaaccaagtggcatttggaaagtaaatacacaggacttaatgcattggagacagaaatgaaggagagagtatcaatcagacagttgaagatactggtctggaactcagaggaaatattaggactgaaaatataactgagagcattattggcagagctatgtctaaaatttatgatgtgagttttgctccaaatgtgtttgagtcccttatttttattgaaacgattctgggcaaactcaaagctagcaatcataatccaaacatattttgggaatccctgagtatctgcatgatgactaattttgtcattattgacatttgctacatctaatatgtattattttcatttgctggcagagagattaatatcataattagcataatgtagaaaattgagaggccgtatgattccccacaaatttgaagaaaatagaatatcgttttgatgaagctgcttgtgttttcctaccctaactcccacccacctattagttaaaaaaaatggtcaaaggtgatttcaaaatatgttttgagaaagtgttgtgctttaagagaacagaattaagcttgttccttaatacacttctattctgtgttcacaagaattccatgggcctttgctgtggcatagtctttaaatgctgtctaatgtaggtaaattgttcaatgcagtaagtgttctctttagtgtgactgactccaacaaatatttaatttagggtaactactaggtgtctcaagttttacaatgataaataagcttgtattttcttgtcaacactctcaacttaatggggacaccctagaaaatgctgtgttacaatataactatggcgattgctttgagaacaagatagatcaatgaatttggcgaaatggtaaggaaaagaaacagacaagttgaggtaattactattataaaggccttaaagacagtcttttccccatttcctatatcaccaagtacagcgctgagcactgctcagcttaataattgcttaagaaatatttgttgataaattgagcagaaaactaagcaagatattataatcttcttgattgctttctcattctggaaagggtcaaaagtaactttttgaaatacatacaacagcctagagtgaaaaagagacatttaaaaataattgtgtttttatcaaagtttcatctcctaccacaaataacaagttattaaggaaagctgtcgtttctcaggctcttgagaatgggaaggcctagaaatacgataaagagggatcaaagcagatctctgtgtctaacatcaattaattgattttgagcatttagcttagattacagaacccccaagacatcaactaacaatccacatctaagcacatgttgggcatcactaagccttatatgtccctcttgccaagttatacaggcattaaacacaaattactcttttatttttccccaagccttaagttctgaggttaggtttcttgttttccaactcattatctgttgtatggtaatactactctccttcatggaattagatgagaagaggtgatgataaaaacaattgtgcctctcttgttgactgggcacgccctctgcaaatcaaaaaaaaaaaaaaaaaagaatgcacaagcatggattcactccccattatcagtacattgtacaatatcaatgatctgtattttattgaacaatatataagccagaggaacctaaggataaagcagacaaatgacataagcaagtcatctgttagatttttctcaattattcatgtgaatatctaaaaggttagggatatttgtaaaagagtggtgaaaactataggttttactttcttatcaatttagcttgtatgaaggaaaagattaaattatcaaatgtaaatcttttctaatttttttctctctaggaacgcttccttcttaggctaccacgtagcatttcaggaccttttcatttgactgaaacctcaaaggaaatattttcaagccaacatccacttcactcctaaaactggtttcttatattcattacattatttatttgaatgacatctgtattttccagtatggataccagcagttcaactttgttttgtccctttttttttcattcctccaatccaaattctattttactgatcctaattgttatacttcttgcccggttgattccatcgttattgcttttcctccagcctggttattcattacacttcacctatgttattaatacaccctcctaactgtttcatctcagactctttcactgcataacattctacacaatctttccagattaatcctccagatgcatagttcttctggtggattccctgctcaaaaatttatactgaatactcagtgcctgcctgttgaagcccaaatagcgtacataacattcagaacctcatagcatccctgagagatacctttttaggcttcttacaatgactttccaattcttcatccatgcttcagtgcaattagacaactcacagtgacgtcctggtcattctccagacctttgactattctccatcctccatcatgtgtgtctttacctctacttatgtaatcctttcattccagttgactagaccatgagatccatgagagcaggaactgtaatcttttctcactctagtgcctagtaacgtgttgctacctggcagtgctcaaaacatgtttgttaaatggataaaggtgtgccccaaatactaactctattgtgaatacattttcaagcaaaagttatctatcctataaattgggaatacattttcaagcaaaagttatctatcctataaaatcatactgtacttgaactgtatctacataatggtttttcacagtctataaaaattaaattttgttattattagagacaaggactcattctgtcatgcaagtttgagtgcagtggtacaatcatagctcactgtagtctccaacccctgagctctggtgatcctccacctcagcctcttgagtagctgagaccaccggtgcataccaccacacccagataatttttaaaatttttttgtggagacagggtctcacttttttgctgaggctggtcttgaactcctggcctcaaacaatcctcccaccttagccttccaaagtgctaggatcataggcatgagccaccatgcccagcctaaatttcattattttgattgaaaatttatgattgtctttatttcagggacattgtcttctttacctttgaggtctccactatgctcatcagttaatttgttctttttactaaatggctaaatgagtgactgagtttcttttactggtatgtggtgaaactgcagaatttttatgcacgttgaaagaatctctaagagcatagcacatttggtaaaaagcatgattaaattctatttctgtacttttaaatacctactaggggtctagcaaaaaaaaaaaatagtgctgatgctgaagctggtcaaagacaattcaaatgttctgcacttcatattagtggtggggttgccaaggaacagagcttttacaaagctaatgccctgctgctcaggcagcaacactgcattctagtagactcttcagataaagtaaaaagaaaagaaacaaaacaggaaaatgtctgtcattcccagtcttcaagttatatgaatgacctcaaaatgatactattttcacccaataatcataaaggtaataatcttcaacacacataatctatatgaatgtccaataaatccatgaaaagatgcttaatagtgctagtaatcagaggaatataagttaaaaccacaacaatatacctacatattctgtaagatagcaaaaattaaaatgactgacaagaccaaatattgacaaagatgtagagtaactggaactctccatcatcactggtggcattgcaaaatggcacaaccactttagaaaactgtttaggtgctgtttgacaatatctcataaatttaaacatttcacccagccattccacttctacagagttactcaaactaaatgaaaacatatgctcacaaatggcttgtacacaaatgtccacagcatcttattcataacagccaaaaactgaaaaccacctgaatgtccatcaaaaggagaatagataaataaattgtggtatatctatacaatagaatattaatcatcaataaaggaatgaacagctgatacacttacatggatgaatctcaaaagtagtatgctgatcaaaatagtacattttgtatgatttcatttatacaaatttttaaaaagacaaaactaatctatggtgatataaatcagaagaataggtgcctattggggctgggaattgactggaaggtagcatgaaaaagctttctgaggtaatggaaatttttattttattgaggtgtcactttatcagtgggaccacttcacaaaagttaacagattgagcatttaatatctttactaacttatacacctgccacagtataagttactgtcacacccagtaagaaagcgtggaaaatatattagatggcagaatctgaatattatacaaagtatcttgacagattgaagttctcaactaaatatgacaggttgaaatgttatgtaagaacaaactcttcctcctctcccaaataagtctgtttcatcttatataaaattttacctcaattaagaaataaaaacaatatcatttttaactgctctccttacttacacaataccttagccatgctaacaatcagggcatccagcaaatctaagtactttctctctcttacttcacacagtacatatggacccttcttatgcaagaaaacaactaactgaaataggctgattgccaaacctcagtcatttgcagacagaatttaaaagagttcagaagactaatcaggttatacaggaacagacttcgtgaaccatcagggatattatacaattcacccttttatccccacacacaatgatcaatttagacaatctataagacgagtcaagtggcatctgtctttcaggaacacacgtgtgtatgtgggggtgtatgtttattagattaagaaggaaaaagcgtagagattcaacgatcttgaatttcaagagaaaatggctcaagaaagcctgtaaaagctctttagaataaaattttgacaatataatggcaaatcatcccagtgagtataaaacaaagatgtgtgccactgtatggacaacctcaaaggtgctcagattctaatagagtatgaacatgggaagaaacgagggacagagaactgagggcaaatattagaagaacaatatagaactgtataaacagtgaggaaaagctgagcttggaatgaattgaggctcgtgataatggtaaagacaacattcagggcctttttacttccatttggaggaagaagaaccagaaagacgaaggttcactgattggggcagaagggagaaggttagggatagagacgacacagaaagcagcagtgtgcagctccttttgcttgtctgctctgtcaaggagaatgttcatcagactggaaaaggcataaccgtataagggaaatgaagcccaaaataggtgagggaattttaaaagagcaccttgctgctctaaatgagctaaaatctctggccctggaccaattatattctagggaaatgagagaacttgcgcaatacagtcctaccccactgtcagtggtctttgaggaactatgttaacactgcagatgggcaaatgtcatctcgatttttaaagacaggaagaggtcactgcgactgtgttccatcaattcctgctaaagagcatttctgaatgatggaacaaggagcaaacaaacacttgttaacaaagacaacgtggaggcagctaatttgggtttgtatgacaactcgttcttacaccagacatgtgtgcctgtgtttgcagttgaatctcttttgcagtatgaaaattgaatttcacatttctaaacaacttaaaaaccacttctttttttttccagctaatgaaagttaaattttcttaaaatgaaataaccatataaataatgaattgtgttctgttgtacaaggagcagcatgacatccagttgcccaccacctgaaaaagtttgaggtcctctggcaaataatggacagagacaatgatcttatacgtgcaccattttgtgttatttgacatggtgacaatgggtctcctttctacaagaacagaacaagaggaaataagattgcagagtagttggggaacctacacaggagggagtcttccgaaaagagatttagactgtatcaatatccagaaaaatgtcgaaggtgatttttggaaaatggcatcattgtttacatttattcttttggttttcttctatcacttttagtggatttttataatgaagagacatacgtttatgatcagaaaaaaataaccctctacccatttgggaaataaattgatataatcttaccaaaacaaggtatttttttctggatttttttattcaagagtgagagaatagataaaatagtctttcccagtactgtatattaattatttaaatatgatattttaaaataaagttatcatactttatctactatggtatcagcacctgtagacataatttactaccatatttgcattagtacatattactaaagtttttcagagatatggccatatatagtgggtaaaagataccaaaaatcataaataacattttattctttctcaagtaacattattcagctcctctaatataatttcagagcttttgttaatggtatttttctacatactagttttgaataaattcatgtctaccatgaactatctagggagaaatgttgttaaaaatgctgttacaagttccataaacttagtttacttgatatcttataaacatgctgccttttgcaaaatacagattactactgaaatcaggaaagcttagaattattaagacagacgtattgtagggaaataagggaaaattgctctaattttgttctgacattcagaatataaagataataggtattatcatgatgtcaacatgctccatcaaaactcccattcaataccattctttttccatatatacttactttttttttcctcatccttggccttaatacaaaactcaatatttcatttatagtttgaaattttgttacatactaccctaatcctatgtggattgaagaagggtataaatcaataaaacttaaaactgaattttctcctttaagcagtttagatattttaattagtaaacacaaacaaataaggttagctatgtattgcacatttaaagaaatatcacactgtcaatgtgaaaagaaatttgtaaggaaaaaaaagaacaaagatcagtctgggacatctgcaatacattccagattcaggaacaacaagttaagtatctacctactcatcttttctggcatgatcttctgttaaaacaaggaaaggcagttaccatacagaaatgttgattttgtcagacagataaagacatcactaatactatgccaaagaataattgcaattatcttattgtgataatttattgctttcatatacttcataaagtgctatcagatgattgttccatttgagatccacgtgaagtatgaggtcagaaaaatgtgttattattcctagggtaaagacgaggaattgggggtctaaatatttgtccaagttgtcctgcagataaaggtcccaggaccaggccccagattgttatcacatttcagtgagattcccattattcggtactggctcttttctgactcaaatacttagatattaaagagatatatgcgagacatgaaaagtagaaagtacaaaaaaatcggcaagttgtacacttttaaattattgtgaaaataattaaccaaatacttcataattatagatgtttttggtagaaaaaagatgattcgatactcactttcctattaaacatctattttgtctttcactttgataatgctgttatcttcagttaaatataatcattatgtgaataaacaatgtggatcaaaaaagaatgagaaatatcaacccagaatatgtttgaagctgatttaaagaggacaacagcatccctagattagattacatgtttttgtaaagctgctatattagaatgtcatgctgacatgattcttgataatgtatttaatgggtaaagtatgcatagtgaacatttgtgtagagttcatcacatctaattttctgttttcttttgatacacgaaggtgaatgatgcaattgtggtatttctgctgttgaacttaatgaaaattctgtccactatcaatcaaatagatcttttctcttgtttgttgtccaaacaaatatgttcaaaagtaattcatttttattgaaaagtcttgtactcacatgatgaaaaaaacacaaacaaggctttaatttatttcacatgcacttgcttgcaagctatacactggagaagaggggaagtttagttttatatttatgtaattcaagttatgtagatagaccaggtgttatataaatggacagatttttaaactagtatgtttcaataaataatatgagccaatcttcagaaatgaatataaacatgtggcatccttctctataaaaacacaaggttgaatggggctcatctgaagtgttgctgcaacagtgtgatgtctgtcctggccgagagtatgtgggatgatttatctcaatatgtttttgcagtaacaggtcatactgaaacaatgatgggacaacaaatcacaatgtatgccatacaaagaaatgatatgggaagaataatttcattcccaagtatttaaaattgatactctattttgaagatcaccatagaattagaaacaatgtaaaagaatagacctggtaataataactataatttctttcaaaaagagaattcataaacatagaaaccaaggactcagagaagaaccacttataaacattagaatattaccttctgccattcctaatttagcatataaaggtaactttttaaaatctctgcttttcataactgagagccagaaacaaaacgtctgcatgatgattaggtgttctttgtatatagcaacagtatccccttgccaattttaacaatattaagaaacatatgccccactctccagaataaatagctgtgtagaagaaaatgctttgaaacattcattgtcttcttaaaatatgaaaatcaacatttaggaaaatatttatgtcgcttctacataatagcctttgggtaagtacagattaacttgacagaggtctttcacgcttaaacatcgacatttaaattttgattgacaaccaacagtaacgagtaacgctttcattttagatatttaaatatacagaagtaccatttgcctgcaagactgagcaaatgaattaatttgttcagtaaatatttattgagcgcattgcatcctgcatcagacagttcctgaccttaggcatttcattgcaggtatagacaaacaataaacaaacaaagatgtacatacacggaataaacacatattgtggtaatagggacaaaagaaaatcacgggatgctttcacagagaataatggagaataatgataacggagactaataatgctcaatagttgaggatttgcaagattatggtgtaactttagataaagtgacctggaaaggctttggagatgaagttactgaaacgggagatgcacaaagaagaacagaattaactacttatccagatggagaaaacagcatgtatgacgctcccgagtcaggaaggaactttatatgcctggatataaagaagctgaaagaaaacgagaatggttggagccccttgaatgaaggggagtgtggaatgaaatcaacttcaacatacagattcatgtacaaggatgttcactgcagtgaccaaaatgtggaagcagtcccaatgcccaataatgggagaataattaattatttacaatcacatctgggagtttactatattgtattgcattttaaaatgacatataaaatttaaaataattctaattattaaacatcaataaaatattaaataaaagatgataaaattttttttgtacaatactacttgctaatgggacagaactcaagaaaacatcaaaaggtgtaaaacccattaagaaggcaacctatgggagaaagactataggtgcttttttgtttgtttgttttgttttttttctgagacagagtctcgctctgtcaccaggctggaatacagtggtgtgatcccggctcactgcaacctctgcctcccgggttcaagcgattctcctgcctcagcctcccgagtagctgggactacaggcacacaccaccatgctcagctaatttttgtatttttagtagagacgggattcaccatgttggccaggatggtgtcgatctcttgacctcgtgatccacccaccttggcctcccgaagtgctgggattacaggcgtgagccactgtgcccagctgtcttaatttaatacttttgtgtattttcaaacttttctacactgagctttaaaaagtataagcaaaaatgaaaaacaaagtgaaaccgccatattgcctttgtcctgaaatattaaaaaacgaactaaaatgggcacagaacaaaaactataatattcctatatgcatgttcacattgagaaaaatagtgagacaaaatgtctgaatcctggtaactatgatagaaatggagtgtgcctatatgcacgtgtgtgaagggaaaggtattctctctcgattatctatatttatctatttatcatttatctgtcatctattagttatctatcagttatctatctatcatctatctgtttaccatctagctgtaggtcataaatagaagacattttaattaatatttgctattgacctattctcaaaaatcactactgaattgtttacaaaactcagcatgctttgccaaataattaagacctttatttgtattcatgagtcttaattgccaaacaattaagacctttacttgatcaaatcaagaaaattagcatatcacctcaaacatttaccatttatttggggtagaaaccttcaaaaccctctcttctagccgttttgagatacgcaataccttactgttgacaatagtctccatactatgcaacaggacaccagaactaattcttcctttctaatcgtgactttgtacccattgacaatcctctccccattctcgcttttcccctacttcccccattctttggtgaccaccgtccatttactgcttctatgagatcgatgtttttagattgtgcatatgaatgagaacaagctgcatttgtctttctgtgtttggcttagttaatacaacatatgaaaaaatgttcaacatcactatcaggaaaatgcaaatcaaaaccacaatgagatatcatctcattccagttagaatggctattatcaaaatacaaaagataaaaagtgttggcaagaatatggagaaaagggaacccttatgcactgttggtgggaatgtaaatgagtacatccattatggaggacggtatggaggttcctcgaaaacttaaaaatagaactaccatacgatacagcaattccactactggggacagagacaaagcaaataaaatcagtatgtcatagagatatctgcattcccatgtttattgcagcattattcacaatagccaagatatagaatcaacttaagtgtttaataatggatgaataaagaaaatattgcatatatatgcaatgggatattattgagtcatataaaagaataaaatcctgtcatttatgacaacatggatgaacctgaggatactatgttaagtgtctgaagttttgactcctgaaatgttataatgtcctcggtttaggatattagcttgagtagaatggcaacaaggtttgcacaaatatttaaaaagtgactcacaagaaaaagtgctatttaagccgggcatggtggctcatgcctgtaatcccagcactttgggaggccaaggtgggtggatcatgaggtcaggagatcgagaacaacctggctaacacggtgaaactccgtctctactaaaaaaatacaaaaaattacccggacgtggtggcggccgcctgtagtcccagctacttgggaggctgaggcaggagaatggcgtgaacccgggcagtggagcttgcagtgagccgagatcatgccactgcactccagcctgggcaacagagtgagactccatctcaaaaaaaaaaaaaaaaaaaaaaaaaaaggaaaagaaaaagtgctatttaaaaatagcaacactaagaataatacaatattaaattttcatagtattttaaagcctccatagcatattaatttattcaaataactttcaggacaccagaactaattcttcctttttaattgtgactttcatacattaactccatgaaaaattgaggtcaccttttataccaattttataactttgaagagtaaccagtgatatttagagaaattatattagggcactctcacactcacgttcttgtgctctcatttctctctctgtctctctctctctctctctcgaaaccagagagggagagacttattgtaataaattggctcattacgaatctggagaagtcccaagatttacagtcagcaagctggagacccaggaaagccaatgatgtagttcctgtctgagtccaaaggcatgagaaccaagaaagccaatgacgttaagttccagccccagaactggaggcttaagactcaagaagacccaaggtttcaattcaagctcaaaggcaggaaaagatgggtgttccagctttagctatcaggcaggagttccttttaatcaggctttttgattaggtcttcaatcgattggacttaggtcctcaattgattggatcagacccacccacacaagggagaacaatcggctttgctccctctactgattcaaatgtgaatctctccagaaacagcctcataaacacacccagaataatgtttgaccaaatgtctcggtaccctgcggcccagccaagttgacacatgaaattaaccatcacagaaattaagtaatttgttgaagttaaattgatagacttgagatttttaataacaatcggttccaaattctagcctgatgtgttttttccttttattatattaaatttattgcaaaatgttcttaaagcaaatttggaaaaggctagatttcttcaggtcagaaattctgccgtattcaatgcatgaagaaagctcaaatgaatctatttgacagacctggagcagttattttgtctgatgctaaggttttgatttacaagcgcaagaaaaaattgtctttgtgctttctgattgtggcagccaagttgagtggggaaaaacaggagaaaaacatgctaatacggggaaaaaaacataaagagaggatttttgcaactcagaaatgaacttatatacaatgaagagcctattttattcctaaaataataatctaaaattttattttaaaaatgagaaagcttgagaggtatttattagattatatactgatttcctttttttaatctctatttttaatgtagactcaggggtacatgtgttggtttgttacaagggtatactgcgtgatgctgaggtttgggcttctgttgattccatcacccagatagtgaacatagtacccaacaggaagttttgcagcacttgctcccctccctcccctcctcctttcggagtgcctaattcgtgttggaaatttgctttaatcttaggggaacattcatagaaaaaactgtacaaagggtttctttacgcattctcaatgatgaaaatcatgttgacattgttctgtcattagaagacatgtacaaaaatagtttttgataaactagcgcttaatgtcttcataacgtaagtggaagcgatgaaaatatactgcaagaaactatttttcaaagtcttcgacatttttactttttttcaactaaacacttcagtccttttgggtgagctctttatattatttaaaaggttcttttcctagatagtttatgtaaatgccttttcctggagtaacctttaaggcattatttggaaataacatagtttctcctaaagtatgtctgtttttatccacaacagtagagtagtaggaaagtgtgtgctaagaaagtacaatattctctttgtcactgtacattattgtagttaccatatgagctaagagactatgctagtgttaaggttgcctttatagtatgattatacctgttattttccttgctctaagtttgttggcatttcacaagaaataatacgtacaaccacaaagttaacttgagctgtgattatgagaaaatggtacaataagttaagcaacacatttaaaacaaatagttcaattactcaatttcatgcggtacagttttaacattgctagtacatcctcagattaaatatacgaaaacattaataactcacgtaagcaaggtgtaaggcagttacacatcctaccacgtgtaaagtatgctactaaatctgaattaaaataaatataagattaaactattactttctagtaggttaacactccgtgaggaaacaagatgtaagcatataaaaagtcaaataaagttttaattaatgttcaagacaatagaagacatgtcatatttcaatacctgatgaatttccaaattgattatacagacaaaatattgtagttcagagagagatcttcaaagatgacaaacaaaaggtctacaaaagaataatttatgagttttcctgaaaaccaatacaggttttgagagttgataagacatggttgatgagatgtataagaaataaaaagtgcaagaacacagggggatttatgacgcataatattgagattatattaaaacaggcattgaatatcaggaagggtgattttataccagatcttgtaaatagaggggatctactacaggttttaaggagacaaacgatatgataaatgttatttttatggctgatcacagtattataaatggattggaatggataatgtgattacaaatggaaaggaaagcaggcagaaagaccagaccagtggcaattacaacgtaaggtactatgacttttatctaagaacttggaaaaaaaagaggtactgagaaggaaaagtgtagcctgcaaaggaggagcaaaagtgggtttgaaccttaataggttggaaggaacaggaagtcaattgtggggatgactttggaggggagagcagggatgaatttgcaaagtcatatggaaactgcggtcatacggagatatccacatgtcatgtccaggtagtagggctagaaatacaggttggaacagagataaaaaacaggatagccaaagccagaagatgagatgtaaacaaaggtgaggtcagagtgagaaagagaaaacaataagcctcaactgatgattttgacacatgagaggaataaaaaactaggaatattacagaagctaaagggttacagactttaaaaaaaaaaaaaaaggaaggggaatatcgcagtggtattgaacaagataaaatggcagagaagccaatggatttggcaaatacattattgttgattttgaaagtttattctacagctatttaaggaatgcccattatgttccaagcactgttccatgttctaaagatacggcagtgagctctcatggaatttatgaaggcaacataaaataaacaactaagaaaaccgatgcatgatacaaggtgataaagaatatgaagagacttaaaacgcagtgtaaggaagtggagagtgagaacagcaggggattactatattactgtggtcactgtaatgggagctaatagacactcctgagggaagttagagggtaagacgtgtggatagctgaagaaagaaggttgaatttcagcaggaggaatcaaaaccaaatctatagagagaggatagtgaaggatttatgttggaatgacttacggttttgtgtagctagtttttcttaaagaataaactggcttatcctcttgataaggaattagtggtgaaagaagctttgaagacatttaatgttaggaagcaagaaatcagagttgtgaagagatatgttaaaattagggcattgcctccatgagcaggccattaaaactatctggaaatgttgaaaggactatgaaagcactagatgatgatgctacgtttctgaagttatccctcatcattggctccaaatatgcattgcacttaaaattttattttataatattttaaagtatatacacaaacaatttaaaatagctgcaaaaatatgatcacgtatggtccctcgtttttcttggctcactcctctcctcctccacccacaacaaaccttcctccactaaaataacctaattatttatttctgtaattttgcacttgatatttttttcaatttatatagtcatatatacttttgtagagcagagggtgagaagagatggatataaatgaaaatgaaactagaaataaattaaaattctttaccaaggtaaaaataaatcttattggtcttatgataatgcattgtcctctgtgatcaccaaaaatctacaatacaaagccagccaatctcttgggagagtgtagaaagtttagggaaatgtaattatattttatttgcagaaggaatcaatatggcggtacttttcaagttcaattcaatcacaaatgtaaagaacagatttgcatttacatctaagcagaagcgtggtggattaaaaagatttcaataacatttagtcatctctttgtcaaaatagggcattcattgaacataatgacactcaaggccatccttccaataaattaccctataaaacttccattcaaaatttaatatggtacaggttggggaatataggtaattaaatgtgtcgtagaggtagaaagaagaccctgggtaaaggaaaagatggtaattaagatttgaaagaataatactgaaataaataggttattctaggaaaatcttatcagtatgctaatcactttaggtcccttatcataggaaagaatcttaaacaggtgcttgggacaatggtggtcaaccccttagcggtttcaaatgctaggagtctcatgacacacaggctctaaaccttgattacctttctacaagaacattgttgcttgttgatctccaatctttttaatacgctaatgtcagatggaaacaaattcgactcctggatggcaagcaagctgcactgggattgggtaaggctagaagccatcatctgcaacacagagataagcgaggctgaattctctgtggccttttgagactgtattatgtgaaatgaagaatttacaagcagaaacagtagctaaaaatctcattattaatgacttttgagcagccacggtttctggtttttcatgtgaatctgtaagagacttaacaaagacaaaaatgtgggcacaaaaaatgtagcaaataaacagaatctgggactaaaatagaaaaatgtaactgtgtctcaaaagtgtttacatactggctgaaagagtgaactgtacagggtttgtttaaacaaaagttatgtaaatctttgctcagctggttgctcaggaaagtaaatggaagcaaacagaggaaaacagaccacgggctggaagagtttgtcaagaatgataacgggcattgaagcatcaggatttaaaatgatagcccagcctctgtaaataatgcaagctcttcaggatgcactagagacccaactcgacagcatgataattttagctaaaaacctgctattccctccacaagactccataaactaaagaagaaagctgagggattgtatacacccaaaacgccaactgttagaagcgtgggaaacctggcacctttaaatctctgattttatcccttagttgcccatgacattgcctgggagattttgcagcacttaaactgggataagttagacaattaaagcatctcagtttttgtctaaccatgctaaaaataagagtgacaggtctgaagcaaacattttgtgcctttgtatgcaaacaaaattcagttgacaaaacacaaagtacaatgactacgaatgagctaaagatacaaaattaagttaggcaaaattcccatgaacgctgtcccttccccgctaaatattttacttccgccactgaaaccctctaacaccaatgaaataaacataagttggtaggacaggtgagaaaaatcttcttaaggagctcaaactaataaccctacgtatcatctggaaaacagtctggcaagaggccttcttttcgcattaaccttctgtgggctccgcacctgacaaagcatggggctgctccccgagaaatgggactcccagtgacacagactaactggagaaaaattggcctgaagttatacatcagtcatttgcagaacaagacttgaggatcatcagcctttggaaatggttttattccaagttatacaggagtaggcacctgctttatatctgcccttagcactccggattaatcgcacatatatagggaaatgaatttctccctgttgatctcttcattgcaatcttgtgcccacaaaatctcaatggaactgcgctaacaggtttaaaagaccaagtcaggaaattcacttgtcacttggttctcaaagtgaacgcgaaagaaactgaagaattcaaaggggtcatggatatttcttcaaagctccaaatagttgtttggtagagatgacgaattttgagccatctgggcaatacgagaaggctcccctgattatccttccttacgtgcttatcaactcacttgcggccctagggagaggatggcatttccgaagttccaaattctctctgtgtgtatctgtgtgcttgagcgcataagttattacatttgtatttacttacttaaatatttattcatttactgaaaaagggcaagaggtagtaaagtaagtccacagagtgaaaaatgagtaggcaaatttgaaagtcaccagtgattactctattggttgaaaagatgcattatcataatgaatgcattagagataacaaacatatgtacaagtgtcaataggtttgtaggattatggctgattttattcgtcttccgtgcaacttcctatatttttcaaattctataatgagcacttattacctttataataagaaaaaagaaaatgcaaaccaaaattgaaaagttttacattttgtggataatttatggcacatctttggaaattttatgttagaggctttcactggctaatcagaaattgctttatctatttttctttgttgaatggaaagggaggagggagggagaggggaataagcaagggagaaataatagggcaaataactggttccactcaagagcaaattaactttccctcatgggtagtcagtacatgttaattgatgataattaagaaaaatgagttttcttttttgtgagcaccaccacacaattccatattttcatattagctaaaggttaaagtcaaactgatccagtacaactttgcagttggatgttaactacttttcatagaaggggccacattcatggtgaatctcaagacctcgtttatttgttaaatgcatctttgcaactattttctatttctccctataccattaatgacacccacaatagtacacaggacatttgatcactatttcttgcatgtctgcatttcctttgctgagaaatagagaaatacataaagaacaaaaaagggctctaagtcccattcaaaaatctacaaacgtgactgctgaacgccttaacaaaagcacccatgaatcggccatggctttatagctgcgaagggacaacacataggcatggagagaaattggaaaaaaagaaaataacgtgaattagaattctgccaatagtattagtgctaatgtaatcaacatgacataagtatgaatctttgaaataccaaaacttcgagtaggtaaagtggttctcaacaatatctttcttctcagggtaatcatagtgaatatgaggatacatcgacagggaaaagaacagtaggtaatttgagggaattttgcagcactaatttagtctccaaacactgattattcagtggtcattattccaaactgcgagggacagtaatgaatccaaacactattcgaaaggcaaactattacagagaatgttacacccttcctaagttgtgagtggcacagatttatgtaatggcaactgggaacaaaaacagccaaggtcagtggaaacctaattgtagtactttatctagttgaataaaaatccacatttttttagcactgaattttcagtaattgaaaacaaaaaaagtggggcttcaattttatatcagctatgataaaagacagtaactcaaaggcttgataccttaaacttcagggttgtttcctgttcattgtaatatcctcagccttacgtagcgttgcaggcatataaccggtccaaaacaataaaaaccatgttgaattaattagtgagtgagtgaacaatgaatgtagaagtagataataagccaggataataagtgatgaactgtgtcagaaccaagatcaacaacaagaaaccaccaacctaactacaccaatgcaatgatgtcatctatgggaagggaagaggaaagggcagtatgctttcatgaatattaatcatttataacgtgtaaactgtatatcttccattccacaatgtgggttcagctcttttcaattaagctttttctttttgcccatataatgatccaatcagaagaaccttagtcaagtgctgctgcaaagaggtgcctgaactgggtgaaccctaaagaaaattctgctgcctgcattggcaagaatccacaagccactctgtatactgcatcttatgtgaatcttctatcatttgtatattcaatcttgaataaatcaatttgccctcttgggtcttatgatcttcgtctataaaatcaggataggtgattgctaggttctgcataatatgaggtttaccttaaggcaacctaggtggcacactagaatcactagggaagctttaaaaaaattcctattctcaggtctcgcaccagaaaaatcaaatcagaatttctgcaggtgggaactaggcatctctatttttttttgttttttgtttttttagagcttccagagtaattccaacttgtagctaagattgaaaactaactctttaaacactaattgttgtcacctgagtaaattaaggatactttcagagccataaaataatttactttttgtacttttttaggcctaaagttatatatttctagaataaagatttgtgcacgtatttttaaagggcatgtggcttgtatttttttttctttgcaacttaatgtgatgattaatattccaaatttgctaccagttttcattattactcagtattttcaggcatggatggctccatagttcaggatttctgcctatttaaaagcagtcgccttaagcacattttcgtctgtcagtagatgtatattcttcctgcttttaataatgaaaatttcattttaagtgataatccctaaaaaggatttcctggcagaatggtttatatcataagagcgtatgggagttaagaataattatgcagcgagtatctttctccaaagagcttaaagcactttatggaattcatctaattaatgttcacactatatccatgagaaggcagtggacagtgaagcatggctgggtctgaagtgagctcccattccatgccttgagagggtaagattaaacccagcaaacgcagagttagtgtagtctaccactgtttgtcagcccatgacaaaaactacattttatcacattaaaataaagaggaagaaacgtataaatcagctgagtttctttaccctttggatttcaagtatcctaacagttaaaaacacaaaaactatcagttcctttaacaattccagatgctctggcattttagaaatacggtcaaagtttgattaaaatgtggagcttccctagtagaacaaacaatatttacactgcttttcattcacacaataaatggtaagcattgtcagtatgtgtgggcatatttacatcaactcaaatgttacccagatctgactgtgtacttttagcccagacggcctgacagatgaagttaattttaatattatctcaagaaaagcattaattatatgcatgcctgttaatacgttctggtggagaaaaagatagaaggatgggagtacataatagttagaaaggctgatttgtaaacaaaaataaaaacaacacttcagtacctcttccctattttaaatcacagtccacagttcagcttttccactgggatcacgtcgtaacctgacctgatttccctaacctggtcagattttcttcagaataaaattaataaaagaattcacagaaggcttacaatttcattaaaatagataaaatagttccaacttcataaaaattgtattggcacattcaaagacataaaagaatacttataaattctacaatgcataatctgtgaaatctttttatttgaaaaacaaagtatttagcaaatagcactgtctctccacatagtcacaccatgctgacagaagataaacataaggtcagtaggtcttcctcaaagacatccatccatacactggagacatgatcaattcatctcatcactttcatagtaggggaataactagcggatactttttgcctaaaagcagatttgactctgatgattatcagtacaaatttaaaacgtcaagtcaatttggagaagtgcaagcaaaggcaccaacaaatcaatagtaagattctttgatgttcatcttttaagattctcctttgtactaactcttgactcatactttcccatttaaagtaactgtttattaattgaacattgaattacttgaaatttataataccagctaataactggataagctcttaagggtgtttccttacctgtacccaacgtacagttgaaaattgtggattatttcacgggaaatttatcctgactgaaattgatagcaatgccatacgaaactttcatgaaatttaaatacatagcattgcataaaattaaagcaaaataataccatttgaatttagttttagccttttgagtttggctaatcttaatcactggatgaccactggcttcaacatagaagaaccatataaaaggaaaagtgtacaaattattttaaagtaaatgactgataatttcttacatatcttataaggactattaccttactgttgttgactctacctttctagacatgcctagggactaattggattactttgaaacaatctcttttactgcaaaaggaaagaatttacaaaggcaaagctctatagccaatgagttaagaagttacttactgaattccagagggtgttccatattatactgtggtagtgaacgtggcagtggttgaagtgggttcttagtggatgaaaagtggttctgaagtcgtttagggatcatatgggctaaaattaccatgatagcttcattagcaacaccacctgaagtagaaactgtctctgtataatttcactcagaaccaagttacttttcaactggtctctccccaggatgtgttcctattagctgcaaattcttacaacaaccttatggctaatgaggattcagaatccagaaatggagaatttgttcctctgaagaaagttagaattttaaataaatactgcaacttctggagacttctcaatttaatgtgactccatagtgatcatagtgaccacatgggtgaaacctcttcaaattgataaataaaatggaatttccaattgtgtatcttggacaatccatgcacaattagaaacagatgtaacaatggctttagatgcatgacggataaactataagggccacagttgcatagtactctgactctataagtgtacattttaaacaccttcaatgccttctaaaacataagaacaaaaattgttctggtaactttgatgacttctacttaatcgttgtctttctcagaacaaataggttgaacataaatgcaatgctgtttgataattttgttaaaatgttcaaataaaaaacagtgatttattaggtcccatcgaaaattgcctatttatgtatacaataagcatgagaaatccaaaggaaagcttcatgaaattaccttaaatgctagtttttaacctcctttgaatgagccaatgtgtgttcccttgagaaggaaactttctcaggtctgtgactatttaaaggatttatttttctattgtaagttttcttttcacataacaccagtgaccctggtgatagtaaagctttagcacttggttaaactcctgcgttataatgtatcatattatcatattgtatagaagctgtactttccagtgggatagtcattagccacatgtggctatataaatttaaattaattgaaattaaataaagttaaaacttcagttcttcattcccactaagcacatttcaagttctcaatggccacattatactgcatttctaacattgaagaatgttctataagataggggtgatagagagacggcttctttgtctatctctgccactagtttatccctggtgaggagggcaggggttgagcataatgggttgcatacaacgggcacatataagtgctcaaaaatacagtgaaccaatgaataaatcttgttattattaccactgacactgccatacattaaatacctttcagattaaaagtgcttttacctatcagtggtttccaggggctggggtggggcaggagactgactgcaacgggagtacaaggaaactttttgaagtgataaaaatatttcctattctgatcacggacgtggttgtaggactgcatatgtttgtcaaaactcatcaaactgtacactttaaaaaggcgatttttttgtgcatgtaaattatacctcaataaaacaaaaaggaattggaaagagagaaagtaggcacttttatttgcattttaaaatttcatccttgacttttagagtgactaaaccagatgattactaccgagaaacaacaataaaaatatttagaaatgtaggatgcatcaagtgtgctttggatgtcaagcaacttaggggcacagatttctaaaattgtcttgggttaacatactgctcagggaagacgctagcgggtctcactgggaagacctctcccctccaatctcacccccaccccactgattctctaatcacttttgattttaccatctgttcctcctggcacaacaaaggttcagcaagaaaagtgacagcttcaacaaccttgtcttcaatgatatttttgaaattattggaggtaaaaatcaaatcggtcgatttaatccactatttattgagtgcctattcatgaagtataaattcatggctataccagtctgacatgatttcactaatattatatgaatctaaaacagtggccggaaaaacgtgtgaccaattctgatttccacattgcacaaaagttgacagtgatgcactgactgttctgagaaactttgagggttaactaggaattaggatcatgatttcttgatcacattccctggaaagtaaaccttgtgatagaatatgccaagcaatttggtatgtgcaaagaaatgtaagatttctgtaagccgttcctttctgggtgcagcaggaacttgattggggatttccattagaaaaatctcctgctcatcatgatggtcaaagcctgacccagcttgttaatcttcagagcagaatgcaacgcacaactgtttgcactatccttttactttcacaaattccagtcgctgttgcctctatggtgtcttttaattcaatgtcattacttcgtgtttgttctctatggtgatgtttattacaaagagcacaaagggaacaatttatgcactaaaggtatgtctctgcttatcagaataaattacccgtataagtgtctgcaaaaataatcccatctacttttcttggtgaatattgagtaaaccgttaacagggcagtgaagcatttgattatcttctcaagagaatgaagaccttcatggtcatcctccttctaggactgagagaaatgctaatttctcctcaccaaggttatgaaggtagcatatcatctttacacctagcattagctaagtttctcaatctcaaaattgaagaagtgtttcagtttgttaagcccatgatgaaagcttgtctttttctctcacattctagtctataagtagcacagctatgtctggggtcttagtttttttttagaataaggatgatagctctgtctgtcttcgatgagggcctgagctctaggcctctggatagaaacagaagaggtaatctgtcctacatgtgaattaatgtgaggaaggaatgagaaagcagatataaagtacctagtcactatgatcataatatacaatttataagtgagagctccgatatcagtaatattgttactagtataactcgctgtctttcaactggtttattcatttagctttctccatatatatggtaagccccaaagcatttttttgttctcctctttctcaagcctttctggtcctatggaaagtgttggagtttattgctacagaaattatttctttagtttattgtgatccatagtttggaagttaagtctatttttatagctgtttttctccttcagagcatattttcaatttaacttagcaaacaggcactgtttttaattccaaaacaaagtaatgcataaacaaaaactctaaccccaagaggttcttgatttagctctgctactgtgtatcctcaaccagatagttaaatttaagaaatggaacttaatgtctttgtctgctaggtgaagcagttgaactgcatgacacctaatgtctctgccatctctaatgctactgtttactattcagtgattttagttagccaaataacaaagtttttaagcaattttagcaccctaggcaaatacacccacagagtgaggattttggcaaactattttaatgttacaatggacagtgctggaaaatacgggctcctcaaaacaaaatcttaccttgcctattttagacccagctttttgagagcaaacaatcaagttttgtttttgttagtttcttctcaagacttatcccagggcttttcttataataagtgggtggtaaataattgctgaataaattatggggactcttagagctataaaagatagaatttgggattacctgtgttgcttattagaaaagtttttaaattaactaaatcattttgtgaggatatatatgaactcagttggcctcacatttgccttgaagttttatgttcctgcacttaaatcaacagtgctttttctcattattttcatttcttcagacttttttcccctaacatagttgataaaattccttctgcccacactgaatctttaaaaacacagagtagttggaaaaaacttgtgttttgctatatgtgtataattagtattctgtataaagaaatgaccgtagttctcttgaatccagatgctgcgtgggggttaaattttacagattcagccatttgctaagaaaaataaggtcaaaattttagggtaagaaaataatgagaatgatttaaacttgtatagtacatttcagtttataaatttctttctaaaagtttctttctaatatagtattttatttaattttgacaacaaaactgtgatgtggataggtgtgccactttatagaaaaaagctaaacaaactaagattcaggaagctaagtaacttatttaaggtcacacacctagtttttggcagagacatatgttctggcttcaagttcaaaatcctttccactatactacaattacccctactttacatctaaaaacacttcctagaaatgcgtaagataaaggtagtttttgttttattcctaaaatagattaatcatgtatatcagagatattacaagttgagaattagcaggatgaaattttgacagaaccaacaagatgcaaactgagatagttttataataacagtatgtcttttaataaattacagagtgaatagtttaccaaatgttgggttaaagcaaactttcagccacaagattgaatctgctgttttatccacagatatgtggtttttattgatcttatacttccattttattttaaaatgtacattttatgttaccatcctgggatcaaagtaacttgaaataataggaccttaggtaaataaatccttctgttgggataaggatgaacatgtccatcagagttgtctctttttcctttgctttttaacttgtgttaggcaagtgacagaatatgtttttgttgttctctgatcccagttttattctttgtcactttttttttctgccaaacagatgcagtatgtttcaacagaaagagtgctccaaatctttaatcattatgaaaaacacagtaccttgaccttgtattttaaagttaaatggagtggcattataaaaattaaattggttcttgctcatttccataatatcctctaaaaagccttgcctaacctagagtggatgtcctatttctttatctttcttgatgatctctcatgcctgcaagtcagctcgtttttctttgctgaagactgcaccccactgctgcatgcactctaaaagttccattaaaatctagggcatcatcactcattcttatctgcagcaggctgctgagcagtgccataccagcaactgcatgcaaactagcctcaaaggacaatattagctatatacattgtcattctgtaaagagaagattccacctggatcttaccttatctcccagagcatatctagcctttccaacatggctcccagtgtcagcgctatgaatgggtctcttgcaacagcaaggattacttaaaaagcaatttaccagcaagaaattagctttttataggacaccctttattaaacttggtgtgagatgagctagcatcctgaatttcccccttgagcccactgagaccacgcgggccaaaagctgtttcattttaaatactgtactataaaaaattatacgtattcctctctgatcttgatgaattctttcttgggatggatgtgttattaggataataaggcttgagagttgaacaatgggctaggatttggcactgttcctgttgtcctgaaatgtgaagaaatgttgatgtaacttactcaatgagatgttccctaaccactgggaatagttcactgcctggggacaccagaggagaactacagagatgggggagattggtgaaagagctggggtataaagatacaaaaaataaagaatattaccaccttttccttctttattatatcaaatatcatttttctaaaccaataacagagtacttctgtgggaacgaataaaaaagataatgataatatcaaatatcattattgtcaaacttgatgacttatttctccattttatataacttgtagtaccatcattaagtagtattaaataagatacccatatacatggtactataaataatttcctgacaagtattttacttcttgtctaatgaagtgaagtgaagcactttaatgaagtggtgggtgtaccagtctcagaaacattccgaagactgatttcctaagtcttccaataaactttagctttagacggtgggtggggtgcaggtggttagattgtcagtaaaagcacctaagccctgggtaaattctccagacataataagactgactctgaaagatctttgttgaaaggtgctggataccactctgccatatctatgtaatagtatccattcttccaacagctatatatctagaatcaactctgcaatatttcacatgaaagactctttttcttagagatttagtttccattgttatttcctgtagctgtctggatggtgtcaaccaaggtgaactttggtctaaatgatttttcctcagttattaagtagtgtgaagacaaaaaataataaaataaatgttgggaaattgagaggtatgctgcttcagttatggaatctatttcacataaaatagttattccaagtctaaaaataataataaatccaaaaccaaaatatcggatgtgtagttttaatcaagcaaataaatgttttatagggccttttgattaagagctcacagtgagactttttagtaatttataaccgtgaatactttccacactaatttatcagaagcctttattactacattttccagaattttcaagggggatgtggtgggatgaatagtttcccctgaatagtcacatgtccctgaaaccttgaatgtcaccagatttggaaatagggtctttgaagatgtaattagttaagaatttcaaaatgacatcaccatgaatttagggtgggctctaaatccaaagactggtgtccttttgcggcactattcacaatagcaaagacttggaaccaacccaaatgtccaacaatgatagactggattaagaaaatgtggcacatatacaccatggaatactatgcagccataaaaaaatgatgagttcatgttctttgtagagacatggatgaaattggaaatcatcattctcagtaaactatcgcaagaacaaaaaaccaaacactgcatactctcactcacaggtgggaattgaacaatgagaacacatggacacaggaatgggaacatcacactctggggactgttgtggggtggggggagggggggagggatagcattaggagatatacctaatgctaaatgatgagctaatgggtgcagcacaccagcatggcacatgcatacatatgtaactaacctgcacattgtgcacatgtaccctaaaacttaaagtataataataataataataataataataataataataaagaaaagagtggacacagaaagacacacaaagaagagggttatgtgaggtcaggagcagatgttgaacttgtgctgcttgaaatcaaggaacacctggggctaccagaagctggaagaggcaaggaagaattcttccccagagccttcagagggataattgaccttgattttggacacctagcttccagatttgtgagagaataaatgtctattaagccacccagcttgtggtaatttgttacatctgtgttaggaaacaattgcagggagtatggttgttattatcctatattgccaagtgcatacgaaatttggtttagcatctattggtctcccagagacacgtcaatcttaaaggatgctaaaagctggtaggctttaggtccaaagattgactagaagtaaagatttcaggccaaatacacagcagcacaggtttggggggacgtggtggggagaaatcttgtaaagtcaacaatccattttctagttactgtctagtcacgcattataaatgacacaaacagctcacccttgaagtcttaacattatgaacctcataaattttaaaaatcagaataaagtctctgaatattcagctaacagtaaagtctttaatctaaatggatgatgaaaatggagagaatttatgttagctagaaaattaagactactgaataatttttctttcagctagtgttccatataatggtgatattttggcatatatgtaagataacacttactaaaaaagaaattatctgatgcatgtgaaaatttagagacaggtcattactaccgatcaagatgatttgctactgcccatttgagagtataaggggacagtgggctccggtgtgactatgaacatatgccctcagtaagcagggcagcttgcatccctgagaagtaaatgagtatagatgtgctctcctcaaaagctttcccttcccaccaggagtgtttgtaaatgttgaggctaggtggaaagagttggaataggatacatttttgcaaatgatataaagagggtgatatgaatacagaattgtggagctttgaagagaaagggaataatgattagcatttactgagtaccgattttgtgccaaatcttgttgagcatttttaatacactcatttatttaattccaacaagagttctgcagtatgagtagtacctattttacaggtgaggtaattgaggatcataggattaaaaaaaattacctgaatttacacagtatgtgtggatgtaaacaacgtgctttgccattctcttgtattcttggacctaaaagacctaacggtgtggttgtataagcaaaatggatagacttgaaagttttagtatgaataagagactgtggtagaaaaacattttttaaaactgtagatttaattaagtctcaaaaatgctgcatgaaaaataagtgctataggaggtaagaggtgggagaatcatttaactgttcacagaggagtgtggctgtgagctgaagatggaggattaaaagagaagcaggatatcatagtctatgtggagtctacatagaggaagaggcaggagaacttctggcttgaaacatgagcatgatggaacctgagggtcctcctaagtaggtataagagggaaagttgaaaagtttgcatgaacccagaatatgaaagtcagaatatgcagattaacttgagcctgtgaggactagaaagccactgatacgttttgagctggtaactaatgtaatgaacctgatatatttctcaggaagattaataacatagcggtatagtgagagattggtaatggggagatgggaaggaagctaatcctatattcaaacatgattatttttagaaacaaatagaaacagaggaaatagaaaataacaagaggaaggaagagatatccacaagattgcacatgactagaaaggcacaggaagaggtcaaaagtgtctgaaggataactgaaaataaagggagtcagtcaatcttttagctgctattgctgggggtctctgtaaataagttgctttccaagttcatggcctttgaagcacccttcattacaatcagtgcgtttttctgtaacacacaacgttatcataattttgttttatgaggcatagggcaaagaggcaatatgcatttttaagttcttgaaatctatgcatgtctttaagttagtagacataaataatttttaaaatccttcacgattgaattgaagtaattatgttgactacatattcaatgaaaattacttcattattctctaaagaaaatggacagagattactatttttatttggagaaagaaacacttaagtctatgggcctgaaagggttaatacaattaatgcatttttaaaagtctatattactctcagatgataactaattcacttgaagaacttagtttgatacatttagaggctccttggagttcttcaaaagaggttgctacagagttccagggtattataatcattattaattgcagtattttaaagttcacaccagatgagcttccaagaaaaatgacccaaatttatttgaaaggtcacatatatttattttacttatccaaccacatggtgataaaaatagggaaaccatgataaaatccagctcaactaggtaggtagtatggtatagcagaaacgagtccctggatttaaaatctgagagctgatttcctctttgattccttcatgtaccaattgtgtgattttaactatactgcttaatcctcatatgtcttaatttctcagctgtaaaatgggcataataatgtttgtcttacctcagtgaggacaaattttttttttcagtgctgtaattccagcagctagaactgcgtttggcacagagcagaggctcagaaatgtttgttaaattaacacgtgaatgaatggataatgaatgttgtgcgcattcagtaacatgaagcacatgaatgtacatatatttaaattttgcatccatatctattaaataccatctggatattttatctattatatctgggtaatgaaaataactatacaatgctgtgctactgcccgtttctttccaattctgcattcaatgacgtcacactggtagcttgaaattggctatgctggagcatttgtgcaacaaaatttgccaaatgctgcaaatcagacactctctctccccgccaagagcctcttgttaaacatttaccagcaaaccactgttccaggtcctcattatctggcctctgcttatactttgttgtcttctatcttctctacaacttttgctgaagtcattctgaaatactagcagtcaccaaaataatccaggctctgggcgtcactgcacaatctccaccttgccttgaaaatttccctcctagaaatacgtatcatgtcttagctaacacttactcggatatccttgaaagcagtctctgactaccccaagttagacttgggtacctcttccatgtgtttggctatcactcagtggttatcaccatgacggtattatcctaacgtatgataataattgcttgtttacttgtgtgcctcccctgagagctctttgaagtacagggactgtcttattcctaattagagtttctgtatcttgcttctacaggagctacccaataaatgatagttccatgaacaactaaaaaaccccaatctggttttgtacatgttggcaattcaggaaggctaagtgtgttattagtccaagaaatgtagtgaatagacacaaccactcttacataggcactctgtgcttgacatgatttcctgaatgttagtgggggaatccgttacactaatccacacaagtagtcgtaatgctgctggcaatttcccagacattaacaatgaagatcgttggcttaatgcaaatcattgacgcctgtgacagatcaagtcaatattaattcctgtctgatacttttcttgtgacatttgaagtcatctctgttttgtctaaaaatcttattcgtaggacagccacctacagggccacccagaatggctcattaagccaacacatttcttttgcatctttgtgcatgaagggatctagagaaaaactatattattcctgttttttccctcctgcctcacacaggtcagttgttgcaccagtcattgtctatttcccttaagatcatgtccccctgggaactacatttcccagactcatatgccaatggacttctctggatggaatacgtcaatgtgtggcaatagcagggaactaaatggcagggaaaatacggaattcagggtatttctccttctctctgctctggaaggtattttgtggcttatggctgaatcccctcttgtgttccaactttctgcttgacgcatcctcctcctgtggttgcaggtcctgccgaacaggacaggccccacctgatcctagctgcctccagacgacttcaaattctgaaatctcatgtcaccttgtgcttaaagccccagccataagtgagaacagcttcctgcgactgccaatccctgggttgttttgatcttttctcgtttggcttctcaggactctcatcacctacggaattaatttcctctattaaactccctcccttggtactatttggaggagttctctttattattattgttttttaaccattttttcttcatagtactactatcttatttggtgatgaaaatcaaaatcaaaatattctgaattatctttggcttcctattttatctgactcctcaagtctaaacagttgtcaagcccccccagtcctttcaactttcattatcttctttcatttctattctcattcctgggacaacaatgtgatggccattgccttttccctgaaatattgcaatagcctactaattggggcctttgccttcagtctctttcccttctctgtttactaggaatatggatcatagactttacttaagccagcttggatggatagaaagatagaagggattattgtaaggtttgaggtgagacgataagggagtctctggggaattcaataacagcatctgtcataactctgagcatgacaaagaatgaacatataggtggtcctggattcaaggcaacagtagaaatctcatcagtaagagttcaagcaatttcactgcacttctcttccattattgtgcctcagtcaccccctaggtgtctccctcatttgtttctgcatttacccggctgctactgtttcttcaatttcttctccctcataattctgaattgtacatagctttcaaggctacaactctgtcatgttattaaagctatacagcttctgtatctattctgaaattcttgggttttccaagaatagaaatctgattgttcagctaacttcttaatgccaagctctggtttcaatcaaccatgtagtggaggcagttacgaagggcccgaatgcacccttttactgggataggacacagggcagttcatttaggaacagagtgataatctattatccaaacaaggatatttttgagagcaaaaggaggcccaataaatgattacataggataaacaagtagaaagtgggattgttctgagtaaactgcaacttacagtcaacgtatagagtactccaggcaggcaagtattgtaaattgagtctatttccacttgttagtttctctactgctcttcatatatatactgaatatctctttctcagtgtagaatgtcattcattcttccctaacatcagcctgatcccactgctacgtcaagtgtgtgttgaaatatttttttctccatgaagccttccttgatttagctaacaggaaattaatcttttcttttctttcctttttttttttttgagatggaatcttgctgttgcccaggctggagtgcaatggccagatcttggctcactgcaacctccacctcccaggttcaaacaattctcctgcctcagcctgctaagtagctgggattacaggtgcataccaccaaacccggctaatttttgtatatttagtagagatagagtttcaccatgttggccaggatggtctcgaactcctgacctcgtgatctgcccaccttggcctcccaaagtgctgggattacaggcgtgagccaccgtgcccagccaattcatctttctttttataataaatgcaaatcgtacttcaactgtgcattctagggcttgtatttattttctattatacattataatttttatgcatgtactttgtctaataggtgtaagttcttagggagaatgagccatatttaatacatttttgtataccccacatggcctagccaatactttgcttatagttggtaggcaatgaatatttattaaacgaatgattgctgagttttctgaaaacatcattcttgccattgttgttttgagctcactcaattattctggatcctgatgtctatgaaatgcaaaaagataagatattgatcacgtctaaattagaagagtggtgagataaacagaaataagaggattggaagttaacttatttacataatctgaagaatgtttaactggaaataaaacggacagaagacattttgcttctgaagagataaacaaggaatcctagataattgaaagaaaaggaatacatttatttctcaatgagtatttgttcaatccatacatgatttatttagacaaatatctaatttgaacatccccttggtttctataatttataacatcatttacaagttcaatttaatgtatatggaaatcatagtgcatatcagttttgctatttttaaaagtgcttcctaatgaaaagttctgatatttcagaaaacatttacattcttacataagaagcagttaaatagtaaacttccattagtagttaattaagaagcattatatcactcttctatatttgttagtgtatgtaacatgaatcaaagccacctgaagtaattcatggggtcataacgtgcacttttagtgtatgatgcatgttatttaatttcaattaaaatgaagtttcagttgttcttcacacaggcctttttcccttaataatacagattcatttccataatactttaggtgatatgtatgattgtatgatacataataggtttttagcatttttaatacaactctacatatccaggaatccaagcattggaaattgaccccttgggcctcgaccaaatcaagtacgtgagacaaatatgagccttcggtacaactagagtagatttattttattccaaccattatgctccctttagctgtcacatattatgacctgggaaaagttgctaacttctctatagtacagttttctcacctgataagcaaggaggatccctaccttctacctcccagagctgatgtgattattaaaagccagttagaatcttcacatagtaagtgttcaataaacacttgccattactattactagtaacacacgaagaaccctgaaagaacataagtgaaggtcagaagacaaggtggagactattatgaaaatgtttagaaaagttctagttgggtcagagattaaagattaaaacgtttagacccacttaattaaaagacaaattttaacatattagtaataagcctcatattagtactactaagcatactcaaaataggtaagactactgaaggtaaaatcaaagcagtaccagaatatctgaggcacattctccttttgcgaagatggtagttcttaacacccttgtgatttgcctaagatcttaacatactctcaaacacattaatcctttaatcctagaacagtgtttctcaaccttagctacactctgggatcattcaagaaatattttaaaatactgatgtctgggtcctgcctccatagattctgattcaattggtctagatgtgatctgggcccggaatagctcaactgtctccccaggtgattcagatacgcaatcaaagctgagaaccaacagttcgatcgacgcttttcaaattttgacatgaataagaatcacttggagaccttgttaacccacagttttcttggccctactcccaaaaactctgatttagtaggcttggggtggggccaagactttctagttctaacaagctttcaggtgatgccgagcatgatggcctgtgagtagcgttctgaaacttgaacatttggagtgtcagaaccccctggagagctggtcacaacaaagactgccgggctacaccccctagagttttcaagtgagatctggaatggggcccatgcaggtctaagttcccaagtgatgctaacgctgctgatcccgggacctccctttgagaactactactctagataaaaagtacttactctccatctgcatttttaaaaacatcactttaataatctactggctttcaagacattttcaccactaaacaccttatcatagcagcttccacggattgctgtgcctttggattagagaaacaagtacataaggcaaaggacatatatattctccctgtctacttggatgcacagctgcccagcacccagaaaccatctgataccattcaccaagctgatggattgtgtgttgttcattctgctccttatctaatagttcttttatttaactaatgactgtaattctcattagatgctgatagaacactaagttttttttgtggaacttggcaaaactactcatggcaggacatcagttggtgagcattacctaggcagcaacacccaaccctcccgctggcctgagcagcaggtgctggtgctgttagtaatgtcgacataaggaggcaatggtttctctggccatggaagatatgttgtgatttaattcaagaattccttcagtttagaggtctattaaatgaccttctgttatgcaatctgcagtcatgaaatcttaaagaagagaaaacacctttgttttagcctaatggagaacaatcccaaggatctgggaatactattatactctatttcaccttaatgtcctcgcacttgttgttctgaaagcccctccctttccctcctgcttccgggtcacccttactcatctatcacatctattttagcacccagactaagatagtaccacccgagtgaagtctttctcaaatgtcctatctctggtcatgctgcctagttcttggagtgcatttccgtcatggtactcattacactgcatgagaactgggattatcctactcacctccccacaaagcacaagcacataggacagaggcggtatctagcacatctttttctctccagcacttcctagcagtgcctggcacagagaaggtacatacgtaacatcttccacaagaagttctttgaagcaccaatcccaccatctgctatacttgctagtgtttccaagatacttctggatccctcggtatttcttccaaatgtagtgtttatgcctttgatcatcagtgatcatttcacaagtgtgtgtgctagccctgaccataagcaccatgagaatctattgtgttcacagttttatcatcagcatttttagaatatatggcacttgcaagttctcagtaaatatctgcctgatgaaacaaataagtttctgtaaaatgggctgttaaacacagatgaaaagtttttaaaaacatcagggcttcagttaagtaaatatttgggataagaagctgtaaatactaacgtcgagtgcaacaaatatgtcaacacaagaagtcattgagtagaagtattgtcataaaatgtgttgggagctttttatgctcccataaaatgcttggggagcaatccttttgcatttagagaccatttagtatttcttttggaaacggctttgtttgaattcccattccatttacgggcttcttccaaagaatttcttctcagatatgtctggaatctcctttttaccttttgattggttattgtttgggcaaacactcattgtcaactagcaactgataagtaaagggaaaaatacaattaccagtttttcaataattttgaagcatcaatagaaacggattaaatatcacattgccttcaaaaaggggccaaggtaagggagataaaagaggcaaatgggagtttggaagctctgctcaaagtattatgaatgttttacaatgtatttcaggtcaacaaacattggcatcgtcgttgcatttttcagaaaagaatgtaagctgggaaaaaagtttagaggcaaattaagacttgagagacagttctaagtggaaataagggggatgggaaaagaaccctgtattgaaacatcattgatttccttctcacccataaacctacactctgctaaaatgtgttaactgcagcaaaatgattaactcggtgagtctagcatgtgggaagtaaatgacatatgtaacgaggaactggcctggaggtagcgccagaagtatatccaagatggcaagatgaagcaagagtacaacaacttcctggtgtagtgcctttcagaaaatctccctctgttttgttgcacatgacttctttatcttactcaactcattgtgtaataaggtagaagtagaaagaacatccttcaaaattattggaaagtgacagaatgtttgagtggatggctttgcaaactgttgaaaatgtttcatcctcaataccaaatgacatttctgctagcataatgccatgcttttttcccccttctaatactatacaatattagattttgcatggaaatcactccatgcatccatttgacaatttatcgagtacctgtttcaagtgctatgtactgagaatgcgcccacgaacatgacagataatatatctgcacataatttacagtccagtaagaattacagcttagcttcttcctgtcttactccagataaagacccttttccctcattccaccctctcaaggtgcataacttaataagtcagcatgcttaatactgttcgatctaattgtcttgagaatgtcattttcttcccatcccacctttttcaaaagtatttaatgactcctttttgcacagaggttcacattcaagctcctcaggctaacaactcatcccactgtaaatttgtattaatcatattctaattgtcctcttttgtccctcaacatgggcctgccactctggtcactccttggctgctcaatataccacccgtgttctttgcgggggagctcaagtcatttgttttttcctttcatctgaagacacatttgggtgagacttggggatttgtatgtttaagcacccagagtgactctgacataccactactctatctataaactctgcttacaacctaaggccaattcagatcctactctttctagaaaacattcattaactgttacttctcatcatgatttcttcattctttatagtacaataacacttactgtctcatttatttcggcatatatagttccagagctatgtaattacgcctgtttcatagacacaggtcttatccctccaatgagaagacatgttctataggagaagcagctattatcttggacctgtattgaacttctcaaccgcacctagcatggctctaagtatacttgcagcatacattgtgtacttattttattttaacatcatgactcttctagcaacttttgtgagttgcatttaactttttcagtctctgtagggcttacttcacaataggtctcagtgaatgaattaacccttagagtgtccgtttcatctaaaggaggattgcctgtttttgcaagttccagcatctaatgtttcaccttgaaaaatattaaccctgatgtaggtcaaatatatgtaaagctgtattaactttgtttttcaaagacatcatcatttttttcttttttctctgtgagggcttttttttttcttttataaagtaaaaataatttcaaaaatcatattgttctcttgtgatgagaaagcacatacaaaattttatttaagcaacttgaacacgcatcaaattgttccctttgacaaaaagagaaaactacttgtctgggctcactagattaccatgtactatgtcacgacgaatatatttctaaagccaaacatgaaaatttaattatcttgagctacataattgttcttctttggcttcttgccgaattttataattttttcaatagatcgaactgaatttacaagataatctttgaatttaaaacaaagtacattactttttaagccagtaagttaaaattccaattctaaaatattacagtgcactcccaaagcattgtggtttaaaatattcaaaattatataatgataatctcagtgcttttcagttttaaggtattcatgttttagtcaaatgtgattatacttttattcgtatctttcttacacatgtttcaaagctcgtaaaataattatcttatttgttctaaaacttccttacgtatgctgtactttgtcccatctcaatgaaattacatgcagcaaatttgttcctaagtcttgtgttcaacactgagactgtaattcctgacgctgtcattctactttttgaaaattttacattcaaatagaatatctcaactctttctatttgtctgtcttcagataacttattttagtttgttaaatctcagaattttcaccctattcatggggctaagttgaattaattcttaaattgtgaggatttggagaaattatagatattaaagccctagcacaaattctgaaacatagcggcttttttgcaaatgttcattttgcctatggatccacctgcaaggtgggcaaggaaagggtttgtagttctattgcataaggctttgaaattcactagtagatcacgatcagtggattgaatctgctgccttactatctacgttaaagccagttatcagtcttgctggcacatcaacaaagcctgtctttctttcaattaaaagttgcaattacaacttgctttcttttaaacctctcgtagtgattcaacctacttgtccccaaagcgtatttgattgaaaatcatgctgggccggcccaacaaatttcacacttatgagaaattcaccaacccttctcatatcatcagcttattcccccatccaaaagacattcccagtaaagtaacattaactgtttagttaattaaagaccatcttcagaatatagaaactgttatggactgaagtaggtctcctcaaccccattcatatgttgaagttttaacccctgcaagtggaggtagggcctttaaaggggtaattaaggttaaatgagttcatatgggtaggaccttaatccaataagtctaatgtcctcataaaaggaagaacagctacaagggatgcacatacacagaggaaaggtcatgaaggagaaggcggctatctgcaagccaatgggggaggactcaccagaaaccaaccctgtcatcaccttaatcttagacgttcaacttccggaactgcaagaaatacatttctgttgcttaagccacccagtgggtgtttaccttgcttaagtcatggatattttgaaatttttatatacaaacaaaagtaatgccaattaataattatatctatttaacaactagctatatattttatatatccaaagttaatcaaccgaattgacccagtaagtgtaatctttgcttatgtaaacaatacaaacccttagctcatttagattggctccaataaaatattttttaaattcagttaaagtcttaaacatggatcacttacatagcaaatatgtgtgcactacaaattgcagctaatcaatcatttctatttatgtgtgcataccctatgacctgacaatactactagcgaatactgttgagaaatttttaaacatgcactataaaacatatacaagaacacatgtgtgttgtggtttgtgatgaacaaaaacataaaaacaacccaaatgtccatacgcatgtaaaatatatacattgtgttatatacatacaatgagttgcacattgatgaacgtaaatatgtaaaacatagtattgagagaaaagaattcacagagaagattagagatggggtggttcccttaatataaagttcaaatccaggcaaactaaaactagctactctttaaagatacaaatacaggtgttgaacatacgttttttaaaaaatgagcattgtttactagaaattcaagataatggttacttttggctctggggggaaggaaggtgattagcaaggggtaacatagggagcttctcccaaaatactgatggtgttcttcttatttgaaactcagaatgttggaacacagatgttcatattattctttaaacctgtgctgtccaacacggtagccattagccacctgtggctattgaacaattcaaatgtgactaatgcaaattgcaatgtgccataaatgtaaaatatacactagatttcagagacttactaaagaaaaaggttaaatacataattagtaatttttatattgattacatatttaaataattgtgatttggatatactaggctaaataaagtatcctattacattaatttctctgtttctttttctaatatggctagtagaaaattgaaaactacgtatttgactcacattatatttccattggacaacaccactttaaacactccctgtaaacgtttatattgtgatatatttcataataaaaaataaatatgtgttaattgtataataaaatccaggttttcacccttaaggataaaaggagtagttttcctttctaaatacaatataaaccagttcaatggaacttataaaactatggacaccttctaagtaagtcattttttttaaagtagtaggtatacattacctcaatcattcaaaagcaatgagatgtggttaatttcaacacatatacagaatcacttttttaaaatctgctctaaaaatccagaaaaggggcctggattttcccaaaggcaaatctgagtggtgagttgatatattgaattatcactgagaaagaaaccaaaattcaatgaaatcttaatatagcctacgtggacaagtatacaaaatttgagcatagcaacgatacaatttaaggattttgctctaaactaattcaataattagggaagctacagaatgcctatattaaaaattatctctcctttgtggaactcaatctgaccatacaatttgcaaagcagataaattacataatttagcattgaatacttcatctgaatagtaaggtatgaatatctaatggcctctctgttttctaaaatctgctagagtcagaatgtcatgtacaagttctaaagaatttttaagagaaaaagggaattaaaggttattgagactttgaaatctatttttatcagttgacactggaagagaaacgtgggtatacacacatacatatatcttctgtctttatagtttatatagattcaatggaaaataaattcagaatctgaaaatgaattttgatcaggccacaggatgtgtgatacacagaatggggaatgcaaacagggaaacaatgtcatatattgcaaaaaaggatttgtttgggcttggaatcaaagagaactcggtataatcctctttttttttttttttttttcttctgagacggagttttgctcttgtcgcccaggctggagtgcaatggcacgatctcggctcactgcaaactccgcctcccgggttcaagtgattctcctacctcagcctcccgagtagctgagattacaggtgcgtgccaccacgcccagctaattttactatttttagtaaagacggggtctcaccatgttggccaggatggtctcaatctcttgacctcatgatccgcccgcctcggcctcctgaagcgctgagattacaggcatgagctactgcgcccggccagaacttggtataattcttccattcactttctttgcaacttcggaaaaatttctaacttatgaacatcagttttctcaattactgtataataactatgctatcactttgaaggattcctaggagcattaaatgtagggtgcctgtcctactgcaggtatctaagacctggggggtattatcatcttagtttatcatcaaataatgctagagaaggaaaccagcattagttctgctgttctaccctcttcactaacagaatttgataatctacatttgagtgagacctctaaataatagaagacatgcagctagtcacaatatcgacgtgtatgtctcactctgtcaataaaactgcacttacaaaaacagaaaagcaaaaaatattttatttataatgttaaaggaagagaatggtgctcctaaaaagaaaagggacataaatatgttaaattgacataaatatgtcaagaggaaaatagcatttctctttgaatataccaaaaagtacatataacatcacagcactattcacaatggcaaagacatgcaatcaacctaggtgcccattaatggtggacaggataaagaatgtggcgcgtatacaccatggaatactacacagccataaaaactaacaaaatcatggcctgtgcaacaacatggatgcaattggaggccactatcctaagcacgttaacgcaggaacagacaacgagtactgcatgttctcgcttaaaagtgggagctaaacattgagtgcacatggacataaagacaggaacaatagacactggggactacagaggaaggagggaggaagggaacaggcaagggttgaagaactagtggttaccatgctcgctacctgggtggtgggatcattcatatagcaaacctcatcatcatgcactatatccagggaacatgtacccgctgaatctaaaataaaagttgaaattataaaaagaaaaaaagaaaacctcatactaacattctttggaaacagttaaatgaaattattaaaagtatgatgatcatgcatgtgtacttcgcttaaaatatttatgtatgggccgggtgtagtggctcatgcatgtaatcccagcactgtgggaggccaaggcgggcggactgccagagctgaggaactcgagaccagcctggtcaacatggtgaagccctgtctctactgaaaacacaaaaattagccaggcatggtggtgggcacctattatcccaggtacttcggaggctgaggcaggggaatcactcgaacctggtgggggcagaggttacagtcagctgagattgcgccacctcactccagcctgggcgaaagagcgaaactccctctcaaaaaaaaaaaaaaaaaaaaaagtatgaaacaaacaaagaatatattattttactattttagaagagaaaagctctaggataggcagcataacatatggtcagaagcagggacactagagccactgtcttggcagtatgaccttgggcaagtaacttaacctagttatatcatttgctagctaaataagtataataataaaacctgtcctgtgggattgttgtgatgattgcctgaattaatgtagagaaagtaatttgactaacgtctggctcagaagaagcattactacaacacttaggcatcatcatgattattatcatcatcgccatcatcattattactattgctgaaatgaatatgaacagaaattaagtctctgaaaagcaggaagccccactttatgagggatcatgtgtccaagaagaacagttgctttcaaatatctttttggttgcaaagtttttttcttcttcaataaatgcaacaggggatcccaatactacaattaaatcagagtgcatttagttgaacctggttggtagcctcaagtcctcatgtgtgtgtttctttccactatacttggtgttctctgaagcaagtcaatatcaagtagaacagaggcatttaatgttaaaataaaactagaataaggcaacaaagaacatgtataaggatgcatgaagattgtctctgggttgagagtactattaaaacagaaatcttgcatttgacttcgtatcacttaaaagcacttagaactattttaatttaaaaatcctactattaaaaataggtttagtatttaaagaggtaaattctaattttctataactgcagtatctgatgacaaccactagccgcatgcggcttttgaaatttaaacgttatttaatattaaataaaaatttagttccttagtgtccctggccatattaccattgctcagtagtcatgtgtatctagtggctgttgtattggacagcacagagacagaacatttttatcatcacacaaagttatattggacattgctgatttaggacattttgttacatggaaaattatgctgacaatattaggtgtgcagaatattaccataagcaatagcaaaatactacatgggtttgggaacacttttcctttctttatgcactgcagttaatgaaacaacttaaatgtaattctctggaggaatttattttcttaagtacttctcttaaagtgtctgcaatatgatttttacctgagaagtgtggcacagtaggaataaaaacacggtcagagttagcaccttcatgaccttgagaagtcaagaagtctccctaagacccaggggctccaggtaacagggataatgacagttgtccaccaaaccagtttacatgaagaacaagtgagaaagtgaatagaaaaacccttcgtaaactctgaaatcctaaacaaatgttacttattatgatcatttctacatgtatttttttcatctggatgaatgtgaatgaagtgtataatttctgtagaagtagtcgagctagtctaaagcaaaatgtcacagttaaagcatttgagataaggcacatttgtggtccaaagactccagggctactgattagagaaaaatgcatgtctggttaaatacatttatatgataattactagataatctggactttataattcagatataaaatattttgttaaatttgataaaatgttgcctcatctccatttcatcaactgagacatttattttgactttagctttagagataataagctaagagctgccacttagaagcatattaaaacttcacgaagttttacaacatgctaatttaatgctttattagcttatttcatttaagattacaaagaactaaaatgatcttggtgaagtgttgatccaatctcattccacaatgggacttaatttctgcctagaaggcaaacttagacatttaaatttggaaattaaaagaaagaaactgttatatatcagtgttactaaaccctgaagacaaaaacatatatagagaattgaaaattaatgtagttcagctgcctgagatttaatatgctgccaaaacaaaatattattcataaaacacttttcaattgtagagactaaattattttcctcctaaatatgtttctttctcccctttcaacgattaaaaaatgtatctattcctctttgtagcacatagctgtatgtatacgtaagaggttaatgccagtagctataacaaagagatcccacaattttagtggcttaagaaaagaaagaatactacaaaatgggcattcccatctgcaaacagcttttctctacccagtaattcagggactctgagtccttccattttaggctttttcatctcctaggtctttgggactcttttccataaggttagcaaatgggaagtaagaagatggaaaaggtatgcctgcaacataactcccactcacattcaattggtcacaactagtcacatggctctaactagatgccagtggggctgggaaatgtagttgctggcttgcagctggatcctagcaagaactctatactatgaaagagggaccacgaattttgatgtacacttgtctctgccacaacatatgcttgaaagaaaagaaaggttgagtattatgacacacacacacacgcacgtgcacacacacacacacacacagagagagagagagagagagagaagcgggggaaggctggggagagagagagagagagactttcatatttttcatacctttcatcctgttctctagcatctaagtaaatagaaatgctgtacctccccttctgttaactcatttttctcccttaaacatgtagaagacaaagtaagtcctggcagagaaaaaaagcttggtgtaaagaagaaaggaattcttgaagttggggacactagagattatcagttgtttttatttttccctgcatcaaacctggattctttcctaataccccttggtttgtagttctcattatcagcatgaaatgaaagaggatgtaattcagggttatagccccaccataggaaccctgaactacagtcttaagaaagtttaagactgaaccctttagcctgttaccttacacaaagcactgtggagtcccttgaacttgagagatccctcagattaccgtggcagcctcttatttcacaaaagttatgtcatttgaaatacagaatcaatacatccatcttctcttgaggaataatgcgagtgctgtcaaatgcctactaaaggactgatgtagctatcctgactgcaaaatgtccttcttgacacaacaaagagcacatcagaccattcagtatttatacaacttgttctttcatctaccacagatttactgagcacctgctatgcgttaagccctaggccggaagttatggatacaaagacaaacatgagtgggtctttaagcaagggagttataaggtcatatttgcattaataaaagtcactatgaagagtagagaataaattgaaggagcaagaagagaggcaggagagggagggagagccagtggtgaagagactgctgaatcaatgcaggtagaaggtgcaggctacccaggtaaagaaatgactgttcaaatgaaaacaagtggataaattcaagagagtttattgtagatttggtaggacctgataaatgaacgtgccttactcgagtatggtggtgccattgtctgaaacaaagaagcaaaagaagaaccccgctcgatggtaggggaaagcttgtgagctgagtttttgatcttatagaaattaaaaggttggtcaagtgtatgaatggaagcagttgcatatacaagtctggaagaaagaagatgccaggatggagggaaaatgtagttggaatcacggaatggatgaggatgaccaaaggaaagtctgtaatatgaaaagtccaggaaaaatccaactttttgaggaatattaaagggagagatgccagaaaatgggctcaaaaaggagggattactaagacttaggcagtacatgttcattcaacaaggagattctggtactacagaagctaaattcccttaagaaggaaggcattttcacccacagcattttgctacagaatgctcgagtataatcagcactaaaaaacatttgtcaggtttggcaacaagaaagttgctgccgtccttcttgaagtgaactgaaggaaaggaggaaattgaaatttattgaacacaaaggaagtgtctgaggaagtgtcttattaatgagatcccaatgcggcatcataagcaagtgatggaagtctctgcatataccattttttttttgtgcagtgttataatgctatattatcaaacaaaacactttctttttcttcatcctcacatacacattttcattttagaaagtcaacgtgcttttacttagtactagtaaatatgtcttgccaaaaagctaaaattgtgtaaatcatcaaaagtctataataatattaatgctctgttttgaacatactgaagcccaggaattgccttatttcccccaacaaccctgcagcttttctgaagagaaacctgaggttcacggatagtaaattatatgccagagatcaagcaggtgggaagatgatagagatgaattttatcccagctctgctggttctttcctcctcatttaacgttccaccaccttattcctttaagctccaagtaccaatctagagatttttataattaattcctaatgtctgatgaaacctgaccgacctcatgcaaaaatattaaagaatacttattgaataaatcaatccaagatacaattgaaaatgtaatttaattaggtagaggtcaaacttcacaaaacagaatataacataaataatcaacaccataggcaataagatagacatcttattgcctcaatttctgcaggggataaattgggaaataaggaacacctaagaatcagaaatgaggtagaaatattgaaataaaaacttgatctagaagatcacagtaagttcttaaaacgcggtcctcctaggacccagcacaacacgtaataaatgctgcctggtttgaattgaacttaaggtagcattaacaagaacttgggaagtgctgacacaaaatggattctcttattctagacaattcttgtactgaatgaacttaatttctttcagttctggcatagtttggatgaatcttcctcataaccatctggttgtcttccttcaattctgtgctgctaaacaaacttctgtttttaatttgttttgctaagtaaacttagtcatgaggaaaatgttagtctatgtggatggtcgtgtaatattctccggtaacctttcccccattacaaataatcacattgacattgtgctcattatccactagtttgaacctatggggttcaatgaagaaatgcatttctatgtctacatgcttagcaaccagatcctggtctcagagataaaatgccaggaagaaatcactcgacgataaatccacgtctcagaatttgctctaagcctgagaggagatgacggagttatgaagtgctagatgttgaaactcttatgtgcagacttcttgagaatggagttaaaaaataaaaacagagaaaatcaaagtcaaagatataaaatgttgagaaatcaaacacctgacattagctatgagaaatgtttatggcaaacactgatcctcgctttctcccaacaagctgttatctaattgttatttgttgtgtgatctatatccaccatttcaatcaaagcatgagcaagacttatttcaatagccatagcattgctcccagacaaacttattcattcctcctccattcattatatttagctctgttacagcatcaactgtggaatcctgaaataattctcttacatgtctgcctccttcaccagattgtggagtctgtgaaggaaattatgtactctacaaatatttattgaacacctaatatggaccagagactgttttagatgataaggagatagcagtgatcaaacagtcaaaaatttctgtccatgtgaatcttacacttcaagtaatgggggatgatgtaaatttggcattgaagaggtttggcttgtaacttggaatcattattttctagctctatgaccttggtaaagtcacttgaccaaaacttgagctgtcttatttataaattgaggatcataataccttatagcatggctataagattttaatgaaatgatatcatatggcctaataaaaaagtagctaagctttactgtatacctgttttatagtagcactgttgtgctttaaatcttacaacaagtcttcaagataggtatgattataggaaggttaaattacttagatagtcacaagttagctagtggaagagctagaatttaaacaggcagtttaattgcaacatctgccctgttattcactgggctctactctgtatactgctttctttagtatcacaaagtgcctgccgtatagagggcagttgtgacagtgaggatgctattagttgctcataacataaagctgcactcaaattaatcaaaaacagtaaacaaagggattctactggttcacgtcattgaaaactgcagaagggggctgcaagtgaagttcaatcagggggtcctgctccatatctctcagtactcttaggtctccctcttgtgtctgtcagccttatttcaggttatcttctgtcatggtattacaaaggctgcagctctaactatcacatatgtatattacttagttcaacgcaagagaaaaagaatttcccagaaacctttgcagtaggtctccttgatttttattagtccacagtaggtcatgaggtcatctttgaacctgttactgtagattgcactggttcatctgggcctgaggtatatgctttattcctagagcaataccatttgcgctccagaggagagttcttaccaccgcaaaaatccacatattcaccaagggaatctctctcacacagtcaatatagtttagttgaattaattaatgtctcaaaaataaattaagcagttctcacatatttgtagacagtattttctaactactaaatgaaataacgaaagtaaaaagaaggcaaaagaagaaatactctttaagcaatctcatgtagtaatattcattcacgtaatcattcctggcatatttctgtttgaaattcagtcatctacatggaaacagcggaaggggagctcaggacaatatgccattaatatttcatacacaatctgtttaacactaaacaattcatttttataggagttttactcatctcccacaaattcaaatgtttgtcttgctaatttttcatatttaaaatttgcttttcagctagcattcattcactaaaaggtctttgtacacctaatacttcgagttcaagctcatgcagaactattttattattttctagtaggaagaacagataaacatttcgttgcaaatgtggtagagttctgtttttaacgccaatattatctgtgttcaatgcattatctcttatgagctacatatttttgggggggattatattttttagatgtacctatttagtgttccaattaggttaatgctgaccgaaagattttatacaactaaaataaaattaaattgattgaagatatattttattgtttatttgaaacaatacttcataagtgatatgattttagatttatactgtctccatttcacattttcatttttagagtactttattgttatttagtcactgaatcttttccacatccctcgtaagttcaatctggaatgtatatgctagtgatttgttaaacatgtaaaattaaagtattgatttttaaatataatgtgtatatatttatttatagtgatatataacagttgtatgtatatgggggctacatgtgatattttgatactttttagattgctcaatgatcaaatcagggtaattgagatgctgattttttattttgtaagaagtaacagaaatgggaaaagaagcacatggaaagcgcttagatgtaaactacttgagtgtcactgcctctgggttagcccaatttaggccatctacacataaaagctcgatgtggttatttcagaaaaaaaatttagaccttaacaagtagggtccttgcccttgggccccatgctttcaaaggcaaagctctgattaggagtctgtaggaccaagccaacatgctcactagaagccccgctcccatgatctggcattcagaatccctcaactccctgggcaaatgtttcaaagtcagttactgggtatggctaaggggtaaatctttgcatgaggtgagtgggaaaaacttgaacatgtgggtgggaaatggggcgaccagatctatgtgcacagagttcctcacagtgcaggatggagtaaaggaggtagggaaaaaaggcaacagattcacaatagctaagatgcagaaacaacctaaatgcccattggcagatgaatagataaatgtggtatatatacacaatggaatactattcagcctttataaaaggaaattctgcaatatgaaacaatatggatggaccttaagattacgctaagtgaaacaagacagacacagacaaatactgcatgattccacttacttgaaataaggtatctaaaacagtcaaactcataaaatcaaagactggactggtggttgccaggggctggggatagggcgaaataggaagttactaatcaacagacattacatttcagttaagtaggatgaattagctctagagatctgctgtccaacattctacctagagtcaataataatgtattgtgcatgtagtatttattaagatgatagatctcatgttaaatgtcattaacacagtaaaattttttttaagcttaagaaaagccaatgtatcctaaataacaggcttagggttagctctaaccaagctgcctcattccagtacaaaactctaaggaatttattttattgtatcaagtggtttgctatttgagttttttccaaattccttgccagggaataaactgcttgcactatttaaaaaaacaagacagacagacagacagaaagaaagaaagaaagaaagaaagaaagaaagaaagaaagaaagaaagaagaaagaaagaaagaaaggaaggaaagaaagaaagagaaagaaagaaagaagaaaaagaaaatgagagagagagaattctaaatcgaatctagatgtccatatcattatgattgtataattgtcaaggaaagcagataggatatatttaatagtctgttgactttataccttataaatattaaatatgtggcatgcaggcaaccatttgcacacttactataggccctgcaaaagttatggggcagttctaacctcatatgactatgcagaagactatgtgatacagattatcaaaagatgacaattttttaaattcccagaccaggatggtatgaggagtgagaagcttttttagacaccaatgcatagctcttacagctgggatgctctccgaaggcattattattcctttttcttaagggaatgaagccagacataacacaagttataagttacgagttagaagccatgacttgaacacattcaaaagcatttccctggcatacatttctaatgtgtgaatcttttgggatccatttgtttctttatttctggcaatataattaagtttctaactctaagctcaacaattaaattgatagttcattagcattttagaagaaacacttcaaacaacaaatttagctttagaaaagaacaggtaaaatttgttacattgatcacattttctaaattaattattttaaatgtaattgaataacctatgtcctataaacataaacttgactatagagtcataatttttaaacactgagtctcttcataaattaccacactatatttttcactgagaaattaaaactatgatattttagctaaaatgtatcattttgaaacccaaaatatagatttcacttttcatgttcttgagattatttttcctgtagaaaacgtatatgctgaaagtggtcattaaaataattatggctctaaaactgcaaaacattgctaacatactaagatctaatacagtttcatggtgtcaaaaatagagtatttcaaagaagatttaaaatggaaatgtaatgcattgaaatcaactcaaacataaatttcacacatattttgcttttttaacaaaagccagcgttactgcccaaaatgtaaatgttctggtaaaggaagatatgtacgctattttcaccaattaattttcataaaaagaagcctagtaaatagaacataaaataaatatttaacatccttaaatactaaaaaattaattatcttcctaaggaactgtgacaaaaagaaaaatgtgatttcttgctttgtaggtcaaaatactttatttgctacttaaattttcaattccattcaacaactatttactgacttgttcttatatgccagaccctgtgttagaactgtgtacacaaattaatgtgatattgtccatgttcatatccatagtccaacccatcttagggagtttaagaagcacttcatcttaagactaaagctattattttaggtgtgtttataatatctaaatcaaaattctgaaatacaattattttgcaaaagacgacaaaagcatcattttactcaactgatcctgaagttttaaggcatatttgatttaaaaaatttaaaaaagaaagaattggggttgggaaaggggagtataaactgatgatataaaaatcactcaatttagactctagtaaggacacaagaattaccaaaacagttacttctcatttaatcattttggtttgtttaaactctttagttatttgggaaagaaatgtattgagtacctgctgtgtgttagatatggtgctaggtcctatatgtggatgtgtgatatgactgatccagttcttatcctaccgtaacttacattctagtaggcaattgcatgagagttccttaagagctataatagcagaaatacaggcttctaaaaaacagaaagaaatacaccttctcctctactagagtgttagaaaaacacatatagtaatattaaatatatacagatacctaatcagacttattggtttggacagtgggataataaggctagtaatgatttcctggtagaaaaaaaatatgtaagtcttcaagagtatggataagctcagataaagtaggaatgggagagataggcaggggtggtgatgtttagagccactgtgaatgaattcatgtcccaacgaaaaaaacaacagggaacgttaggatcgctgattccgggaattgtacagacctttttccttgcgtaagctaagtagtttttagagttacaaggaaaagagatgtaagagactggaggaagaaacatttaagaatctgaaaggacttaagtccatctgggaaggaaaagggaaagggaggaatggcaaaggttagggcgaagtgtgttagggggagtagacaagtgagagagtcctttgtggttaaagaactagctaataaactaggtctgaaagttgttactctatccctggaagaacaaataagaattactgaaggcttttaggcagaaaatgaacacattcagatttttgttttttaaaaaattactctagcttttgtgtagaaatagattggagaggagcaagactgaaattccagagtctagggtgtagaaatagattggagaggagcaagactgaaattccagagtctaggcaagagatagtgttttgaaatctaagcaggagatcagggtcatctgacttttggttttgggtgtaaagatggggaaaataagacattctagagagaaaatgtaagaacgtatttaacaacaaaacttagtgattaattggaggtatagatggtgtccaggcttctgctttattcaactaagtggatggtggtcatattaaataaatcagggagccagggaggagaagcagaatttatagatgaggtgatgagctcaggtgagtattttaagcttgaagcacctgagggacatctaaatagagatctattagacatttgtgtattcttgtagcttcctcagaaaaatgatttgggctggaattatagcttaagggtcatcaacataagaatggtaattgcgttcaaagacaagattacccacataatgtcaagtaagaggaaaagaggtcctagatcaaaactatgaaggatgtcgtcaatacttaatggaagggcagatgaggaattcacaaaggagttaagagtgtagagtcatataagcaaggaacagagtgttttaagcagaacagagttgacagtggtccataataaggtgaactaggataaagactgtagaggacccaccaaatttagcaacatgaggaccatcagtgtccttgatgagagtacctcccatgagcctttgctgctagaagtcaatgtgcagtgtgttaaagcagggctggcaacatgatgtggagacaacaaatatagataggttgtttatgatagagggttatctgtaaaggaaagtcaagagggaaataaccagtgtagcacatagacttcaagggttgttttaatgattaaacaaaaatactagagaatgttcaaatgctcatagaatatgggatcaatctctttctcaaaatactgataggatgatgtgaaaaatcatgtcttcatgagcaagcaatgtggaggcagtatattcccacagaacatattcatggaagtgttaacacaaaatattttaccaagtaatgaccatctctaaaatcacatttgtaaaaactagcgtgctttattaaatcttcatgggcaagattaactgatagacacagagcatttatttgttcaaatgttgagaattacaaattgaggaataattatttctaatgatagattcttaaaactcttattattaaagatataatacactaaaacaataattttcagttatagcctccttccattgattcaaacgaaagacacacaaagtgtaaccgtgcataaatactgtcaagctttgaggaatatcgatttctggaaatcctccgttttattggtaccgagattttccacagaaactcactaagcaccactttttgtaactatcccatgatactcattatacgtgccatgcacacggtcaatttctagtaaattagaaagtaactagcataatcctattatttatttaatttcaatgatgttatcattgaatctccagtattctagaaattctttgtttccagtgtatattcatatatggaataaaccactatttattttaaattatagcaattttagaaataacctcattattccaatttttcatgttctgcagacatctcacaactgaacttcccaggctacaactttaatgtggcaaacacataaccaaaccaaagtagaactgaccggactgtggcagagcacatggtcatttgttcaatcacttggtcattcaacaaacgtcttctaatcagctagaatatgtgccaaggtctggccttaacataagagatacaaagaggaataaactgtaaatagtcattgctctctagggcaaatctagggaggaattcagacaaaaataaatcctcatataataatagtagaaaactcaaaagggacattaagacggatctatcgactgccttaagccatgatgttggactagggagattatacactaggttcgtctgggaaaggtctggtgtacagctttgtcccgtgacctttcctacactttttattctcaaaataaatacattagcaatgatcttgtaaggtgaaacaaaagtccatcaggaaaacaggagttggcgggtgggaaatggtaccttatgaagagaacaaaggaaacaatagcatgggatatcagagaaactctagcaacacagtatagctggggtgaagagtatctctgggcgaggtcatcagggacaaagtcaattagagggatagacagagttccaagtgtcagggaccttgttggtcagactaagcaatctgaactatttggaaagcaaacaaggtaaccctggaggattcctgaatttcaatctagaatcacacactatacttttttttttttcaattttgcatgacgacttcagggaaacatgccaatgaaaaaatcaagttaaatcattacattaataaatttacttagtctaggatttggaatatttattgcaagtcaaactaacctgttagtcattgcatataaacaggttggctaaaatcaaattttaaaatgtagatatcaataggtagtctctgctctcaaagggcttacaatttccctgtaatcgtgtcacttggatcagcttacacagattataatcagaagcagagacagcagagataactcctgaatagagaaactaggttaagaataatgggcatagatatgtctgtgtgtgtatgtgtgtgttttagataagttactgatcttctctgagcctaagttttctcagatgaaaatgagaaccatgaagccttccttacagggtgaataatggcaatccaatgtaaaggagggggggatatttattccaggaaaaacgaacaagagaagtagaaacaacacatacagtgcttgcaaagtgtataataggccttcaagaaatgagaattattatgctatgtcacagtctgatctcattagatactctcaatggcctcatgagaaggatgagaaaggaatacatttctcccattttacaggcgagggcacaaagagaacaaaaaatcaattatttgcttcaaattatacagctatttattggaaacacttgggctcaaaaatatcccgtttccaagtctttaccctttctaaaatgcacactgtccgtgaaacatgccaaattgattttatcatcactaagatgaacttatccatagatccttgtgcccccaaatctcactgtctcagttcttgggtgcctcaagtccaagttcccagggcatctgtctatgagtaggatattcacagtgagtaaaaaggtaatgccataaaaatctaggtgtgggttagtagaatccaaataaacgatatagaacatcacaactcatattcaaatatgttaactaaagtaatgatttcctattacttagagtgagggtctcaaaatgttcctgaaatagatctcaaaatgtattccctctgtctagttgaaactttgtaatctttgaacagtaactctctattccctcactccacctcccaagcctctgttaaccatgattctactctacatctctatgaattcaacttttcttacattgcacatttaagtgacatcatgtggtatttgtctttctgtgcctgggggaaaaatgttcatgtacctcagaagtaaacacattttaagcatgtaccctatataaatatatattcacagacatatgtaattttaaattacattgacactagttttgtagacacaacttacacatcacatacactataaaatatacaatcaaaatattaatttctagagaacaagataaataaaaagtattttttctcactaccccaactgtttagcacgcatattattgggcatgtacattccactttggtaacaactgacctagataatcaaattcaaggtcgttggagtgacaaaatccttcataacttcactggtgtgtgtgtgtaagcgtgtgtgtgtatatgtgtgtgtgcttacaatccccactagattttaaactcaaaagagaaccaacaatgccttcatattttttcttctctctcttcaatctgtgttccctgagatccttttctatttggttcactggccctttaaccccaaagcagtttccactctgtggaagaaggaaatagtttcattatattttggctctgggttgtttcttcatttaaaaccgtagctaaagtccagaccagagaatgatttgaaaaccataccttaagaatgagtttttcctagtacagtagacataagaactctctggatgggggggagtcaaaaagaaagttggggaggaagcaagaaaattagatgcttgtaggtttccgaagagggggcctgatgtggcagtatttcatcagcaagaagggcaaaggcagattcactaaatttcttgaggcctcagagtgcagccagcaagtggctacatttttcctgtccctgaaaagagtgtgggagttgactgaggaaaagagttggtcatagcaagagatgcttaactgaaaagctgcatgggccatgcagtgttaaactcaagaaattgaggccttgagaaggggacccatgggcagatgctcaagagtaaagacattcagaaccaaggtgcagacaaaaccgtgcatccataagataacaatgtatacagacacatcccctgaaggccatacgtgcttcatgaacacttgggaactgggatgcctacacagaaagaagatggggaggaacaatcctaaatggaaaccaatgaagaaaacctgaaatcaatatggttatgttttctgtcttcaagtagaaaggggtcatgtccatccattcaaaagaatggctaagatgagattaatcttgcatttcccggatgcattttccccaagttggagtgtaagccagctctttggagctttagaactaagcatcatctcttcttccttgctgacatatgttctattgaacatcttttctcaaaatagacctgtttcgcccacattgaaaatctgtcaaggcaggtctctccccccttcctggtgatctccacaagtgttggaagggatgtcctggcagtcgtggacctgcccacttactgccaggtggtgccgattcaactgggcgcagagcccatatggcatctgtggcttgagacataagtatcatcagccacagtattccccaaattcttaaaaaccttctgctttctgagttaacattgggcttattgtcatctagtactgttgcttttattctagctgtatactcatatgtttgagtgttttgtttactgatacttcctcagtttttgtttctttcctgtacatcactgtaacagcagcacattctccacacattgaaagactcattgtctgtccttgagcatcatctctactgtcaaatgatagccctcgtacatgcatccactacattcatcattgtctcactatttatgttttgtaactctcattattattataggtcttcagtttctaacactttcaaattagcactgtcgttgaattaggcataattagatttaaaattttgctaaagtactccacaactaaggaagaacagggctccaagtggttaacattaactttggtgggggtatgataggagagtgttgacgaacctgtacttggagctagttttatttctatttaggctattactctctctttctccatgcttccctccctctctcccttcctccctctctctctctctctctgttcatatatatatatatatatatatatatatatatatatatatgtacacatatatacacacacacatatgtatacatatatacatacatatacacacatatgtatacatatatacatacatatatacatacatatacacacatatgtatacatatatacatacatatacacacacacacacatacacatacacacacatatatgtgcaataaagaactgcctgagactgggtaatttataaaggaaagggatttaattgactcatagttcagcatggctggggagacctcaggaaacttacaatcatagtagaaggtgaagggcatagtagaaagggcatagtagaaagcaaggcacctcctttacaaggtggcaagaaggagaatgagtgaggagggaagggggaagagccctttataaaaccatctgatctcatgattcactatcaggagaacagcatgggcaaaaccaccctcaagatccaattgcctccacctggtctctcccttgacacacggggattataattcaaaatgagatttgagtggggacagaaagcctaaccatatcaatgtgtgtgtataatttatttctggtagatgaacatgttcatcaaaatcaactatataatcacaatattaactgaaatatctgacttttaagaactttaaatattttagaggttgcctacggctgtacaagtaaataaattgatagagcacattcttttaaatataaaatgagaggaaatagtcttaattagattactacattttccccatggatgtgtcatagtacattctagaggaaaaaagtaattgattatatgaagattagaataggtatatttaacaagcaggtagtgtttgtggaaatgttctaagatgttagaaaaataagaataagatctactgtttcatagcacaatagggttgctatagtcagtaataacttaatggtacattttaaaataactaacagagtataattagaatgtttgtaatacaaagcacaaatgcttgaagggatagataacccattctccatgatgtgactatttcatattgaatgcttgtgttaaaacctctcttgtaccccatcaatatatacaccttcctcatgtaccccgttgacatatacacctaccatgtactcacaaagataaaaaacccattgaaagaaaaaacttaaaagaaaaatggaaatgctctaagagatgacgacaggtaatatacgtcttagtgcatttatgtatgtgtttatttttgcaagagatagacataactgtcagcccctggacacagctcagtggatagtgacttttgctaacacttaatggattccatatgttcaataaaaaatcattatgagaaagttcactgaaccttttatacaaactaaccatgcaaagctcaattcaaaaaggcacctaggaagtgaatgcaatacttgcatatttcctttgacatgaataaatacaaaggcattttattttaattgagttaaagcataatagtttctcttgcataaataattaaaatagaaagaaaaatagcatataaggagacttactgatatcaggcactgtcctaagtatattatatacactgaaatatctatcaaaacaagcctatgagagacgattattagatcaatttgagagaaaaattaactgaggcttacgtaggttaactcccataggttatactaatagtgatgcaataaaccaggagtttcacctaggcagtatgcccaaagcccatgtattttaatcattataatcagactcctacattacataccactgattttaatttggaaagataatttttttctagaaatgtttctcaatagtattttgttctaatacaaatgtgaacacctttaaaatcctaaaagtgttaaacaagttggggggtaataatctgacattctcccaggtaaggggatttcgaataaggtcttcctatggcatggcaacattaaagtcctcactaagcaacatgttatttaacttcatgacactgggaagagagtatttgccagctttagaaagcaaatgttaagaatctaaacattatcaaggggactattttgcttaattttgagctttcaacactaaagaagtatataaaggaacatgggtatacttcaatgattatgtaagggtccaggctaatcaaatcatcactgaggtggctattacacacaccaaacatataatcagaaaattgtggctcatgagaagtttaacttaagcccttcctattcaataggggatgtcttaggaccaggatgtttgatgatatccctgaaatcacaatgcctattaatgttaacagcctattaaaaaaaaaacctacacatatccttttatcgttattatttatttatttatttatttaattttttttttgagatgaagtctcgctctgtcgcccaggttggagtgcagtggcacgatctcggctcactgcaagctctgcatcccaggttcacgccattctcctgcctcagcctcccaagtagctgagactacaggtgcctgccaccatgcccagctaatttttttgtatttttagtagagacggggtttcactgtgttagccaggatggtctcgatctcctgacatcatgatccgcccgccttggcctcccaaagtgctgggattacaggcgtgagcctccgcacccagcctatatcattgttattactatcgttattactactattattccaatgttaatatggtgcccactgttttaaagtagaaatgctattatttaatcttcttgtgttcgtattcaataaagaaaaatataagtattatgacaaggcagtgatttggacaggatgtttcgaatgcaggcatgttgacatataactggacatgagccctgatatagtttggatatttgccgccactcaaatctcaagtggaaatataattcccaatgttggtggtggggcctggcgggaggtttttgggtcatggggacagatccctcatggttttgtattgtcctcagtgtagtgagtgagttttcatgagatctggtttttttttaaagtgtgtgggcatcaccttctgccatgagcaaaaactccctgaggcctccccaggagccaagcaaatgcctgtgccacacttcctgtacagcctgcagaaccatcagccaattaaactttttttcttgttgaaatataatgccaagtgttggacttggggcctggtgtgagatgtttgagtcacggaggtggatccctcacagcttgatgctgtcctcatgatagcagctgagttcttgagcgatctgttttgttttttttttttttaaatgtgtggcaacctccccctggcttctgctctggccatgtgacatgcttactcctgtttcatcttccactatgagtaaaagctcccggaggcctccccagaagctgagtagatgctggtgtcctgcttcctgtacaacctgcagaatcatgaatcgattaaagctctttttaaaaatacattacccagtctcggctatttcttcatagcaatacatgctaacacagacccaccctccccgtctgtccttgatactcttgtttttctgccgattttattcctattgtatctactctttgtttgatgttaagaaaatgatctttgcttcaaaaattcaaattataatcctgcaagctctttgatataagtgttcaatttaaattaaaaaggcaaaaccaaaataagactaagcataagaaaataatacactttcccttagttaccagagtgatatatttgaacattttaaatgctttcaaaaaatcaaatttctaaactgttacctctacttaatcccacagaggtgataaaattattggcaattgatgatcatgtggataaattgactgacaatttcattcatttattcattaatagctcctcattgatgtatgtatcccaaatgtctcctttccttctctcaaaggggcaagcaaaggaaatggaaactgtaacagtaaaagccatatactctaaggtggacattagaaagtctcttggtctacaggtcgtttttaatcctaaagacagaataatctacctatatagaaatcattaaacaaatagaaattttgccttataaatagtaggaaaatacatacctacatttatggcctgaaaaccagcatcagctatgttatagttgtccacatagaactaatataatgtactgggtagaaagtgaccatttttctccattttgacccttgtcatcactggaagaacatggattccattaaggttcccacattcattacccttctcctcacacagaaatgcaaacattgaaaagtttcttcgtggagagttctattttgttttgttctttttgcattaaaagttcaatactatttattcaagtttatcaagctgaatgaacaaatggcctattataattgcatttcatattttgggcccttaaatttcgaaatctacgtttccaaagagaaagttaaaaacaggggaaaatgctgctaaattatttgatgagcttcatatttgtgatgctctcattttagttacattaaggcaaaaagccaaaataaaatcccaaggcttggagtttgaaacaagtggtgaaagggaagggagcattgataagagaggcaggaaagatagatttaatggcattttttttgttttaaataatgcttaagaagaaaaattatgtttattacactcagtttatttccctgtggaagaacaaccttttcctctcctcagtctggaactcatactctttgccacatgacctgtgggaaattgacttgaacagatgttttggtttcacattaaatctacaaattattttgcgtaattccctagtgcccatctactataatttttatgatgtctctactctttgttttttacatactatgacaaaagagtcataagacatagtgcctagtcagtaattggctcactgaaatgcttagagtttatatatttgtaagaccacacaaaatttcaagcaggaacctttcagttatcacaatctttattaatactctcttgaaattgacactttttaggcttcatatgccaaaaaacatgagagtaataattgaccttatgctttaggacatgtttcttcttaaatacttcttattttaatattagtaacaattctactactaataatatctatggttcattgaatgctagtctacataggtgcatagatacctggatatagatgataaatagatgacagagaaagagaaagatagaaacagagaaatatttttactttgaatgaaatacattatctctcccatcctaataaccaccttccaagataagttcacatcttattattagagatgagaagatttagttttaacaatagtgtttgactgaacttgaaatacacaggtgtgtaaatattaaaacattaaaacattcctaaaatctttgcagataattagaaagagtctagcaaacattatctgtaataaaaacatatatatttaatttggaatgtgctttaattttgtggtattttgtgaccactctgttccttgtcccttgcctgtgattagtgaatatagagtgttcatttattgacacttttatccactatctctggaggacaaatgtgaagtagttgccaagactctactttaggcagtttcacatatcattaaaacaaaaatttacagattatgtatttccatgaaatatgacaataacaaattggaaggctgagggctaattttacacataattttgcaaatctgtttgttaagaatgagtatgcaattcatacattgacattctggtagttcatcagtttataaaactagtgaaatggaagaatgcattgaaatttaattgttggtatcttcacacttttgctgactatattaaaacagatacattgaactgagtggtcccgcctcctaataatttataacatcttcagtttctgccactaatatttatcattatcttatgaacaggtctgtgcattgaaataataataaaaacgataaggaaataaatagacataactattatttattcagtgtattattaagtgtatgatataatgccaggcatcctagatatatcatctcatttactcctcacaatgaacctattaagtagatgtccttgtgcctattttaaaaatgaggaagataaaacgtacagaaatttaacattttgcccaagattgcaaagcaaactaaatgcatgaacaaggatttgaactgtgtttttttttttcatctggaggcctccgttcccaagcatgcttttaaattttttttttctcttgacacatatcataaggtttcttctcatttttcacatcatatcaaccagtctctttgctgttcctggaacagcatattcacatctctgggcctcggctcttactagttccttatcctgactcatttctttagatagtagcatgtttcattccttgacttgatttaggtctctgctcagatgtcacactctcagcctcctctcttcaccactcttgctaaaatactgcttccctttttcctttaccctgatgatttttttcatcgtacttttaatctgatattttatcatatttattgggttctttgcctcccctgctaaaatgtaaattccacaacaaagggacgttgttttctttatggatggatacctggtacctgcaacaaaacctggcacaggctgattgactagtattggttgaataagagcaaaaatgaatgactactgagatttaccctaaaattttcaaatattttgatgtataaaaatagtctatgaatgtaaccaaactgtgtggacagaggctgatggggtctcaagtggtgtgtgtatgtgaagggtaagacattttagaagaagtacctatgctggattttgaaactctgaaaggacaaacgaatggagggaagaaacagtagactgcgggatacttgagaacgagaagaaacaaacaaacaaacaaaatgaatgaaagccactgtcagttcttggaacacagagttgggaaaatgtattatctatatctggagaaatactcaagtcaggggaaggagaacagatgactggcaatgaagggacctcaaagcaaggtctaattgagatttgagacaacagcatgcatccacttggagttcttacaaagaggaatactatgttcaactgactcgtacatttgtaatacgtccgttaaaaaaaccctattgctattggaaatgagtatggaaagctttcagaatggaagttttattccattgttggtaaggggtgcaataaattattcatgcataaccgcaactacaaggaaatgggcataaagaggtgaggtaagtaggaataagtgctagtgcatatataattactaaatggaaatggtttgacaagtctgatacaaaaaggctctctggaccccaatttcaaataaaagacctgaagtgatacatttattccttatcccttcagagtctccattttctataagcgagccccctccacaaacgcaccattaaacctgtacaatctatgacaacaatgggaatttatccaagatgtagacgtagaagtgatgggtcaaagtgatccacagttcacatcagataccattaagtgtttttatagctctttacctcctctagtataaggactcaaaaatacagcttgaatgatccagaaaattgaaggtatcaggctttagtgatacctaacaattagttggatgaggttctgcacttgaagggcacttggtttttcaggaaggaagattttttttcagtaatttttgtattcttactggggtgttccttacactgtattccatccctaagaaaatgctactttttcattatcagttgtattgtatcttgacatctaattggcaatacaccacatttctctataaattatctcgtttaaacagttactttcctagttaagtatatttaacaacttagattctgacagttttttaataaacgtattttggtatttttaattaaaatcagtagagtataaacaaatagaaacacactaaagacaattatgcattttaataaaacaaatgtgcaggtccggaaatgttcatagactcttgattttatttacctttagtattataccaaatgtgaccagtcatttttcaaatttgagcatggattatgttttttttctgcctatatcaaatagtataggggtccaaaacaggtttttagggagttattaagtctatagaaaattatgcttttaggaagtgttgtgcttatgccaagtgggagaagcataataataaaatacaaagtttacaaattatactgcctaggttatacaattactacataattgaaaataaaatttaactgctgtgtacatcatttatctatatcaaagttacctatgcttaatttgaaatcactgtaataatgctgataaatgaaagaattgaattgatttctacattaaaatgtacaattaaacctgctaaatatgcaactgtactttttatatgtgcctttattgtagtaaggatagaaattgttgattgtaaatgtaaaccttatgttctataaggaatgatttcttaaaaagggagtctattacaatcagtaatatcataaaattttaaagataatagatgtttttcatccagttcaaaatgcttcaccatgtgggctttttgatcctatctttaaaaacttttgtgtccatgagaagtataagttaggtaagttttctaagttaactgaaataaaaacacattgaatttcttaaaatcctagcaaaatagtgtaaaataacgtacctatagtcttctctggcacatctttatatgaataacgtgaatcatgtataaatatccttgaaatatgtatttcatttacattgcctcaggctaacttcctctttttttttttttccccctaatagagacaggctctcactgtgttgcccaggctggttttgaactcctgggctcaatcgataatcccaccttggcctccaaaaatgctgggattacaggtgtgagtcacatcacccgactttcaggctgccctcttgatcacacccacaattactgattttttttcaaatggaaatgtattttctaacataaagtataggttagacaaatgcacaccaaatgttaaattcccttctgtgtctagtcatctctgtaattatgaagagacaaagtttaataatatgaaagctgatgaagaaaaaataaccccataatttataaatgtgcattccccagagtgaaaatggctcttggtaacttcatttttaatttcaattatgtattttatataaggaaaaatcacaaaataggctgcttactgtagtgttgaaatatagtgtaatgatagaatgtaattttaaagaaatgtttaaataaataatttagaaaactaaaaatggcctactttttatgatgttaagtatatggaatgctgaattaagagagtaaatttttcttggcaaatagtagacacactagatataggtgaagtgaatgaatatgtagaaaatcagttccttaagaacggctcaatgatgatatttagaatctagtgataattgaaacttagtttaaaagtgaactaagataactaaaatattttcatgtgcttattcacataatcaaggcataggagttaagggtctcctgtcatcgacagccctagagaagttacgaaagacaaatatgagacttttaatgatatcagatattttggggcactgcactgtcatccttttaagcaaactagattctctctccaccacaagcaaaccctaagtgggagatgcaagtacaccttgttctttaaactctggatctttgtattcacaggacaacattcaataaggccacctgtccattgtaatggagatcatgaaataacctaagtttactttttgaagtaatttgggaaatgtagaaaaatatgttcccaggaattttcgtattgggtagaaatatatgcttttctgcaagtgcagtataaaagtatgaaaaataggatggagtaacaggaaaataagttttcttagttgggcagaccatctaggcatagaacctgagtaagtaaattcccccaataattaatcttaaggttcacttttcacatagaagttaagtcacataaagatacactcttgctcctctagctattaaaccaaggtccataatttttttttttacttagtttccactcccagggatatgaaatttagattcttgaccccaaatgaatcttaacacatggatgaaacacttcaaaaagtatagtttctttcctgtttcaccagtcacctgaccaaatcaccttatcaccccttaattcaaaattgattgtgctctctattctagacttcgagtgacccatattttttgccatttgtatttttctttaatttcctagcccactttaccggtcttctcattgtatgttcagaataaaagaaaaggaccacgagaagaatatcctttatggtactatatgaaaacgtggcatgaatatgacttgactaatcatacaaaaatcagtaacatcacactactgtccacagatattgggttagtcagatttcattagtttagtcaggtaatcgagaaacctgcttgaaattaagtgggaaggtgggcacaacgataatcaaattttataacatagcatactgaaggaaatctaaagctgacattaattggaaatgaatgagagtagtagatccaaatatctgcagtaccttgagcagcaggagatgaactgtaattgtcataggccctttaattacgcactgaggaacaactccaccaaaacatcactgctccagaataaaaacaaactataaaaggagagttgcaatgcctctttcttgatgaaagactttgggaagacttgggcaataaagaatactcataaattgtgagtttagtttcctgaagagtctttccccttctctcttgtctattcccacaccactgctagatttatcttcctaaaatagttttagaaacttgcacaattgaaaatacaaaattgacaatcagactaaaagaaggtgtaatagttaggtcacgcattcatggatcttagaatgggacatagtggtcaatgaatctaagaagctctcaaatgtagaattctcatctaagcatccctaacagatgacaagtcaattttggcttagacagtttcagctcattgctttgtgatgctcaaaatactatggagaatagctacaaggaagttatctcgtaaagtatgctgaaacattctttcctatacttctttttatcatttggtcctgtagtagtttactagatcaacacagaatgaatttccccctcaagaagtatatgaataagggaatgatacacatcagaaaaggtacatttcttcactttgttagctcttgttcactacttttagcacagctggcaaagctcttaatgtcatgcctctgtctactttcctattacagaggcattgttgttttttctcgcccactctcaagccacacataccactctccagtcctaaatatgcccttgacttttgtcactatgcctttgttccctctgtcagagatcttccatgttctaaatgtcttcaaagacttctcacccgttaaggttggttctaatgacatctccctgtgcaatctcctaattgcatctttgttggcacacacacatacgcacaaataatatatgctttgttcataaatcacattttattctgcttaaaatagttctttaaatcttgtccatgttcctctccctagttctgtaaaccttttgaaagtaggatctataccttaaggtcacctaattttttttctcttttttaaaaaaagactatatacctaaatcaaaggggggaattaaatgcacataggaaaatattgattttgtccattagacttctaaatctatacacaagaagctttcattattcacatatatccttaatcatattgtatatgtggggtatgtgtgtgtgtgtgtgtgagagagagagagagagagagagagagagagagagagagagagagagaagaggactgaggaaccaaaaagaaaataagtcaggagcataaggaggtattttcttcttttttttttttattatactttaagttttagggtacatgtgcacaacgtgcaggtttgttacatatgtatacatgtgccatgttggtgtcctgcacccattaactggtcatttagcattaagtatatctcctaatgctatccctccaccctccccccaccccacaacaggccccggtgtgtgatgttccccttcctgtgtccatgtgttctcattgttcaattcccacctatgagtgagaacatgcggtgtttggttttttgtccttgcaatagtttgctgagaacgatggtttccagattcatccatgtccctacaaagtattttccttttctacaaaaaaattctaattgacctgtgcacattattttcactttggagaagtgacttctcctcaagtaagccataacaagtgtttgccaaagctagaattagctaaccacttgctcatttgcttacatatccccgaggcaccatacaggacattgctgatactatggaaatgacctacagaagtttggacatttggtgaggaccatttttcactttttttcattcctttctctatgtgaaggaaatttaatagtattatgtattctttaataccttaactctttctctaatgtgtgagagaggggagggaagggaagggaagggaaggagaggggagggaagggaaggggaggggaggggaggggaggggaggagagagagatcaaaggacaaagaaaataaccagagatacaaggatgcaaagagaatttcctttttctacttccaaaatctagttattctgtgcaaaaacgttaagaacgaactttggaagaaaactatgcatggtgaaaatgctgctgtttaaaaactacaacaaaacagcccatcatagagtagaagaaacaccggcctgggaggacaagtgcctgtgttctatcacagagctaatgttaacaagctgctcattgacgaaaatctcgtcccttatatcagactcaatctcctcattcataagatgagaaatttgcactagattatcactgaaatttgctccacctctaaaatgactagggttccatattctggtaaattaaacagagtaatgttttaaattaaagatattatcacaggtgtgtaatcttgcctgttgagcataaattaagaatattttcaaaacgatgtgacattcaatttatagtaacagattcaaaaagcatatttaaaaataaattatagctagataggagaaataagttctagtgctctatacgactgaatggtgactatagttagcaataatatagaagtttcaaatggctagaaggagaacgttgaatgttcccaacacaaataaatgaccaatgtttgagataatggatatgctaattaccctgatctgatcactatacattacatatataaaaacatcactaggttctccatgaatatgtacaattattatttgtcaattaaaaaaattcttcaaaagtaaacaatgtaaaatagtagacgtgatgtgaggtataaggagaacttcccaatcaattttggaacataaaacttcatttctgaggcaaaggaagaacttgacattttatataacttctttgccagaatccagtggctctactatttttctgaagaatgcataaaatcacagtatcatgatactttggaatttaggaggctgctatactgagtttagtcctgtctgtttgtatctaacaaagaaatctttctttttctccaaccctcagtttctccatcttggaaataagaaagttagatgtaatgataacatgaatgtccttacctcttaatctttcagttttatgtgatcatatgagtatcttctctctgatcaagcagtctgcttagtgatttgataaattaaatgataaactttcatttgctttgaagtgttttttattttgtttttgtcactataaaaataattaatttttgagtatttacagcattgtccttccaactgctaaagaaagtcatgtccttgccattttcttcctcaaagacttagaaaaagaaggacaaactaagcccaaagttagcagagggaaggaaatattaagattagatcagaaaaaagccaaaattgaaatagaaaacaatagaaaaatcaacaaagctaagagtttttttaaaaacaaatcaataaaattgacaaatctttaggtagattaagtaaaaaaaaaaaaaaaaaaaggaaaattcaaataagtaaaatcagaaatgaaagaggagacattacaactggtatccaaaaagaatgcaaatgattataagacactgctgtaaacaactgtatgttaacctagaaaaaaatgaacaaattccttgaaacatgcaatctaccaatattgaatcttgaagaaatagaaaatctgagtaggccgaaactagtaaggagattgaatcagtagtccaaaaccttccaacaaagaaaagcccaggaccaaatgtcatcactggtgaaatctaatgaacagttaaagaagaattaacaccaatccttctcaaattcttcagaaaaattaaagagaagagaacacttccaagctcattctacaaggggcatcagtatcctgatatcaaagtcaataaaagacactaggagaaaagtacagaacaataccgctgataaatatagaagcaaaataactcattaaaatactagcaaactgaactcaacagtatattgaaaggattatacacgagagccatataggatttattcttggaatgcaaaaatggttcaatttatgaaaactaatcagtgtgatacacaacattaacagaacaaaggctaaaaatctatggtcatctcaatagctgcagaaaaagcgcttaacaagtttcaacactttcatgataaaaacacacaacaaactaggaatagaacgaaattaccgcaacataataaaaaccgtatatgaaaaacccacagtgaatatcacatttaatggcaaaagactgaaaatcttttcccttaagatcagaaacaagacaagaatgcacacttttgccacttcttttcaaaatcgtaccagaagtactagccagaacaattagataagaaagagaaataaaatacatcaaatttggaaaggaagatgtaaaattatatctgtttgcaaattagatgatctgatacgtagaaaatcttaagagtgacgccacacagagacatggttagaaccaataaacaaattcagcaaagttgcaggatacaaagtcatcattcaacagttgcgtttctatacgctagcaacataaaaacaggaaatttagaaaacaatctcatttacaatagcaataaaaagaataaataacttagtaaatacccaaccaagaaggtaaaagatgtgtgtgctgaaagctatgaaatattgttgaaagaaattgaagatgacaaaaataaatggaaatacatctgatgtgtcatttaaaagtctatatatccaaaccatctacagatacagtgtaattcctatcataatcccaatcgcattttttacagaaataaggtaaatttcctaaaattcatatgaaaccacaaacgactccaaatagccaaaacagtcttgaggaagaagaataaactggaggcatcacacttgctagtttcaaaatgaattaccaaagctacctcagtcaagagcgcacgatagtgtcataaaggcagacatatagaccaatggaacagaatagagatcccagaaataaacctagcatcaccttcaataggggtgccaagaatacacaactgggaaaggatatcctcttcaaccaatggtgctgggaaaactggatatacacattgcaaagaatggaattggacctttaacttaaactatacataaaaatcaactcaaaatgaaatggagtaaagacttaaaaataagatctgaaactatgaaactcatagaagaaaacataagggaaaaatttcctgacattggtcttcacaataattttttttggatatgacgctaaaaggacagccaacaaaaacaaaactagataagcagaaatatatcaaactaaaaagcttctacaaagcaagggaaacaatcaacagaattaaaagcaacctatagaatgagagaaaaggtttgcaaaccatatatctgataaggtgtcaatatctaaaatacatgaggaacgtaataacaacaacaacaaaaattcgaacaacccaatttttaaagtgaacaaaggaattgaatagatatttctccaaagaagacattaaaatgaccaacagttatatgaaaagatgttcaacatcactaactaccagggaaatgcaaatcaaatccacaatgatatactacctcacggattaggataaccattattaaaaaaaaaaaaaaaaaaagcccaagatcattacatgtgttggtgaaggtgtaggaaaattggagatgtagactgctggtggaaatataaaattgtgcagcttttgtggaaaacaatatggagtttcctcaaaaaaataaaaaatataactaccataagatctagcaatcccgcatctggatatttatctaaacgaattcaatttaggatcttgaagagatatctgcattcccatgtttattgtagcatttttacagtagccaagaggtgtgaacaaactaaatgtctattgacaggggaatgtataaagctatgttatatacatacaatggaatatcattctgccacaaaaaggaaatcttaccatatgctacaatgtggatgaatcttgtagccattttgctaaataaaataagcaagtcgtaaaaggacaaatactgcacgcatccacttacatgaggtatctaaagtagtcaaaattatagaaacagaaagtacaatggtggttgctaagggctggaggagggaagaaatggtgagatgctgtgcaatgggtatagactatcaggcatgtagggttaaaaaaattataaagatctgctatgcaacattttgcttatatttaacaatactgtattgtgcacttaaaatttattaagagggtggatttcattaaaaaaataaaaacaagtgcttcattaagaaaaaaacatctttttcaacacatacaattctttgttaatgaacttaatcattgaatgccaactggttgggaaatggtatacctgacaacatagaaagccatcagacagctaacatggtatttgcaacttctcgtgagggtgggagcaccataaacacatatatgaagagataataaaagtccaaggcaacaatataagatgtagcataagtgacctcgtaatgaactgaaatagatattaagttgatattaaatgttgtgtatcaacggcagtgtgagatcattgtgaactagaatagtgtagcatatcttttggactaaggtagattattccaggctttaaattccgaaatatttagagagtaagaaggacatagagagaccattcagacaacagttgcaacggaagtagacttgaaggccagaaagagctcagcatgcacagggataaaacaggaagagcccagtgctaaggattcactcaggggaagggtgggtgataatactggatgcttaagttggtataagatagtaagatacctgaaatatgaatctgatgttttagttttttaaagaattttacaaaacagatttttaaatagctgtagagattcaaaagagaaacgaagcagttgtacccaaaagtaggataataaagatctcttgattgtgttaaattataaatgcatactccatccatagggtgatgccaaagaaggaggaaacaagtagtttgttatttgtcttcaatttatgctatgcttcttctctgtttgaagaagttgacctgtctgctcgaaagccatatccagcagacccaccgattacttgcacagtgacagaatttaagggtcaattatattcatgaactaatttatttccactgagtttactgatgaccctagaaaatttaagcggtgacacaggactgtaaattctttgttgcattataaagctccttcaagaaattaaaatgcttaagtgaaaataatgatctatccaactttgagtggtttccctacactttttagtgatcactttctggtaagagacctagaaaaaaactgctgaatgaatcctcaatttgtcaattttttggaaaaccaataccttctacagctattgaaaattcagagggcagtttgcaagaaacttaatctatatcatccttcctgcaaccttaccacagccatgattttatcttcatttaaagcacgagattgaaagatgcattgtgagagaagttccggtttgctacttccttcattgttatttttaatctttgagatatacaataaagcatcattaacctgaaagaaagaacacccctccagaacacacagtaatcaatggcaaagttaattggaattgagttcttttaacaattccaccttagcaattctacaatgttcctagtgatagacagttttaatcaaagcttggagtatttgaaaaagagacaaataatgtaaggaaggagataatttgtgactaaaacctagtctttccactaaggatttccttttctttaaagtttcaggtttggagctgaaacactttttgagtagagaagacacaggatgggacagtggttgaaaagaagttggtctgggtgcaaatcccaactgcagcatgttagctgagccatcctggacaactcacttagcctctctgtgctccagcttctttgcctggaaaatgggaacgataataaaacgcactttggcctggcacatagtaagccttcaataaaactatcactatcatttttatgaagcaagataaagcattcttcttgaaccacttctctacattttttttctgaaaggttagagctcaatgagaaccataaccccaggccagggcagagtaaagaaagatatacaattcttcagatctaagcagttgtttatggatacctcaaaatgattgtaatattaccaacatacctaaaagaaaagacaggtgggtcaggctagtacatgtttacttcctacactgaaagcattttgattgatgctattctgactcttccaaattttaatggctcctgttaaccaatttcacctgcacactgggctcgtattcctcatctcagctggtaagaaattaaagtgtctcagtacgatgacaagaaactactgagcaggccattcatcgttctgaaaacagtatgaaacagctatcatcatacctctataaattaaaatgttattttctttctacagttgtgctctgactacaagcatatcggccattcctggtggggtccagttcattatttcagtagacgtaaataatttttagcacaggtatttgaaattagaaggcgattcagcattggaattgagaattgtccacaccactgcttataaccttggaattaagaaatgtggaggtgccattgttccctggggtcatttccatcattctgtaataggtcttttgtttttgttgggactgttgtatttgccacctttggtcaaatgaatctgaaacaattctatagctagagcaacaccacgaaagattgttttgtcactaaaatgatgagctagaaaggaaacgcataggaaaaacatgctcagccttcctatagctaagaaaccaatgtacggaggccagaagagtagttcaagttcttcagaagcacatgaactctttattctaataaattacagagtccacatgtgggagatgcttcactatttagtgaaatcatttcacggaataatatagatcaatgtttctcatgctgatttctccaggtcttagaaatctgaggtgtcagttttaaaatctcctggaaaatatgtgtacacatattcagggtcattcagctcaactgaaactgatagctgattacagtgttcctgctttgttgatatttataaggtctggcttcgtatcaagcagttatgtaaagtgtaaagaattggtgagaatgaacattatgcaccctccatgaaagaagaccaaatgacaaccaattgtatgaagaaatgttaaacacaattagaatggaagaaaacaagtagatgaggagttagtgaatgctacctaagaatacagatattaacctagaaatatgttcttgaataattacgtgacaagagctagacacagaataaatatatcatataatttcatttctattttaaaaggaaagtttatataaaattctatatatgttatatatattaaaacacgttcatatgaatacagataaatgtcttgatgtgaatggatgattcacatgaacacttaagaaagttaaatggggcaaggcagaaatgtatcagctctttatacaatactatttttaatttgttttaatgagcatgtgttacttttgtatatcgggaatacgtttcttaaaaagtataagtaaaaaggattttagaataaatggaagttttaaaacaagcagcttgccatatgaagaattcatactagtctttttggatgaatgttttaaataggttaacacgctcagtaaaatttaatctgcacaaatggctttgtcttacacagagaggatctatgtggaaaacagaaccaaaagccagtccaaacaagtaaaacagaaactgaatgtagagttggaactgatattcaattttggattagaaactgattattgaaaggaaaaaaaaacacagtaatttcagatctgctgtttcagtaaacctgacactaatctgagttttttaaaaaaattaattctgacaaagcttgagataatgttttaatagtgagtcactacaaagtaactattaagtattcaacattcaattaagtcaattcagcttttgatgtttcagccaggtaaatgctcaacatgtgtggatataacacatgttatacttttccatttgtgcagaattttctactcaaataatgttttaagtatgtctaacacacacacacacacacacacacacatgattatatatccatatccttcaacaaaatctgaatatgccttcactataaatcttttgattaggttagaaaagacaatctatcctttggagtgatcaattgcctatgagttttgtccccctcaactgctgcttagtccataaacggaacctcagaagttctgctggaagctacagttgaagtctttctataatgttctcgttgctaagactttagagctagccatagaaacaaactgcaaatgttatttatgctttatgtagtaaaatgataacctgaatataagactgggtctcgattatttgtttcatttatttccacactccaaaaagtctagatccacaaaatgcaaacctaggattccacgcacaaaagggtgcaaacacgaacttttatgattctcatatctttcaaatatacttatgaatagtttattactatgggacaggtatggataagtgtcgatttctttactttttattattttttgtaggtacatagtatgtatatatatttgtgggttacttattgagaatccattcaacgagtatacaaagatcgcggatattaaaactgaaaagaaagacaacctggaagttaaaatgtttgacattaagatttactaaacagaaagtttgcaaaatttcacaaactatataagttcatctgatatgatggatgcttccaattgtagaatacagaaattatattcttgagtttacattttaaacttgtgagatgtttggactgaatatataaatagaaatgacttaaaaattttcatgaatattttcagtggatactattacaaagctcaaagtggaggttaaaagttttgactcattcgatttattctcaacgaatgaattatctaatatttcaatgtatatgagataaacatgtttatattagaatgtcaccaattgactctttaatatataaagccttaattatgtttaatctataaaaccactaatgttagagactattcatcacatattcactataagataaacactatggagaaattatgcataaatgtgttacattaaaatactattaaaaagacaatttctatgtgtgtgtgcatgtgtgaagaatcattcgtttctctatccacttgactacttgtcatttctctgttatatctaagtgtaaaatgcagacataccagaatttttgcatgctgggtttctgggctttctaggtgataaaagtgcctaattattccaaactgttagatcattaatcctagccacaaaaacatctacattaatttaaaccttggcaaacgttaaacaagtaaattacgaaagtatgagccatcatgtcctacttctcttccattgtttctcagcatcttaaaggattttatttacaaaaacttagtaatcccttaaatacatttcttcagtatatctgaatttcctgtttgttgtgtgtattgtatgtgtctgtctgtatgcatgcatgcccatgtgtgtgggtatatggtgagctaaagaggcaaacagtatatacattagctaactacaagttttctacccaaattttcccacaggccacactcaacccattcttaaaatgttgcttaggcattcatcttctccttcaggataatgggggaaaatgcttatgctttttatttgcttcttgtagataatgaaaattttattattcaccctagcatgctatcgatgcttcagctgatcctttaaacatctggcctactgtttaaaatgcatggagtgaactgatgtcagcccgtgctgataatcagaggaccttcaattaagtacctacgaagcaaccaatgataaaagagaaaagacagtgcaagtttgccaaagaattctttcatagtctgattctcaaaagcaattagaatcacttcttttggccttggaattaatgaattttcattaaaatttaaatttcaaatgattccaaggatatcaaacttgagaagttgagctgattgtctacgtaataaatcacaccacaggaacatgtcaaaaagactaatgcaagttctttgccgtccaaagttttgtttctccttgtcagtgctatgtgaacatatataattgctttcttttcctggaagcagcttacccaaagacctaccattattacactccgtatttctctctgtttagaatttttgaaatgataactccaagattaattgaaactagttcaagtctacaaaacaagtttgctctcataattgaatgtgatatgatttttataaattgctgcagttacattcttcacactgtaatttgcttaaatgaggaaataaagttgaacattctaatatcaacatatcctgtatttgaaagtgacatttaacttaataacacagacattgtctttacttgacagaaaacaaaatacattggatgtttgtgtatgtgtaaagtaagtgttgtattttggactgtacagaagtataaccatgaaaagtgctaaacatctttggccatagaaagcaacacgggtgttttgaaatggtaataaaattgagcaataaagcagaaaaataatattcatataaaagtggtcttgtctgtggacgttaaatattttaatcttgaattaaaacagcacaacacgtaagtaataggcacattttgttcactctttaactcattctgacaaaagtatgtgcatgttttcaataacaaatttcacagtacctctttctttcctcgacagtgaatcttctttgtcaggaaaaaaaatctcaacagtctaaagaagaattttcttaaacatgacatatccatatcaagcagccatgaaggaatgtttctagttcttactgtaatatttttcttgccatgtccctcttcacaggtgtactttgaatcagattgattaacttatcagtggtttaattgttcaatatttgttccatgtattaatattttataaaggattttgaacctggggcaaaacctctgcactaaatttcccccatccatcgatcttttccaactcagcatttcaacagaacttaaatcacaggggtgctggcttataaataaatgtataacaataaataaaaatagatgattgtggctttaagatatgttcagagactggaagaaagagcagaagtccccaactgaccatcgaactgttctaatgtccattttatttgccccacatagtgtttaaatatttcagtatatagtcagcttggaacctcttgcatagatagcccttactacttcatgcttttctgttacctgactacccatgtgtacattttgttttgcaacacctgcattagatgctgacatgttgattatattgtattatactgacactgcatgcctagcctcatctcgtccctactttcacagctgagatctagagccctgttgcaaaaacattttaacctctgtagagagcagggcgtttttgtcttccgtttttacttgtaggtatcattaagtcccctatatatttgggtgctgaagagataataataatgaacacacttacgaaataaataaatcagctcatcatatggtgactggaattacttctgtgcgcacaaactaatgctaacatttttcggatgcacaaaacatgtcagtacatagttaccaacgatggatggatagaaatattgttttagaaagtctgagttttaatataaaaatggatgagagaaggaagttcctaaattcatacaaatcacctatagtggaaatggggatatgtagaaataaaataaattaagcttaatatttagtaatacagttaaaagcaattcaatatataacccatggattgggatgatttttcagtctactgcttacaatttcagtattaacatgctcttctcacttaaaacattagaaaaataggttaaaaattttcagacacatggacaaagaatgtttttatctttctgacagattatcagaatatgtaattattagttcaataaataaagaagtgactggtaacaaaaatgcaaaagaattcacactgtgatcaaagcagaataggatctccgacatgacttgatacaaagaatacacttccaattcacccaatttttatttttatgtataatacattagatacttttagtgaccacgaatatttatatgacatctttttttttcaacttttaagatccagagggtacatgttcaggtttgttacctggatatatggcgtgatgctgaggtttgggatacaaatgatcccattaaccaggtagtaagcatagtacacaataggcagcttttcaacccttgtctccccctttcctttccccttctattagtccctagtttctactgttgccatcttcaattctataagtacctaacatttagctccaactcataactgagtacatatagtatttggttttctgttcttatgttaatttgcttaggataatggcctctagctgcatctatgttgctgcaaaggatatgattttcttcttttcgtggctgtatagtattttatggtgtatgtgtacaacatttactttatccaatccaacgttgacggacacctatgttgatcccattactttgctattgtgcatagtgctgtgacaaacatgtgagtgcatgtgtctttttggtagaaccatttgttttcttttggatatctactcagtaatgggattgatgggtcaaatgatagttctattttaagttctttgagaaatgtccaaactgctttctacagtggctgaactaattaacattcccaacaacagtgtataagcatccccttgtctctgcggccttgccagcattgggtgtcttttgactttttaacaaagccagtctgacgggtgtgagatggtatctccttgcggttttgatttgcatttctctgatgatgagtgatgtgacgcatttttcatgtttattggctgcgtgtatatcttcttttgagaaatgtctgttcatgtcttttgcccattttttaaatgatgttttatgatttttgtttgttcaattgtttaggttcctcatagattctggatattacaccaccgtcagatgcataacttgcaaaagttttctcccatttggtgtttgtctgtttactctgttgatcatttattttgccatgcagaagctctttattttagtaagtccttgcttgtcattttttttttttttttttttttgcaattgcttttaaggacttagtcaaaaattctttcccaagccaatgtccagaatggtatttcccagattttattctaggattcttatagcttgaagtcttacatttaaatctttaatccatttcccaatgcttatttttttgttgactttgtcgacgaacagttggctgtagctgtgcagttttatttatgtgttctctattctgttctattggtctatgtgtacatgacatcttggtaggatttcaaacctgttcaatgccctaaaaaaatataacttttaagtgatttgaaaaaaactgcctgctaaatctaaacttggaaactgcctacttaattctataatgagaagggtaatctcagcataaatttcaaaagttaggctaaactccatatctacttgacaagtaaccatgagcttaaatataatctgagatcacccaccataatatggaagtgaggtaggtgagattggatggtttgggagtagagatacaatgttataaattccgaattggaacatattgacctgacaactgggtagaatatttgcaatcaatattgttcagagacattttagtcatttggcccttctgtaacagagtcatagcccaatccttatcatgaaatacctgggacaaagtatctgaaatgttaaaagtttgggggacgtaattatggtttgtggtggaatcgtaggcatgtatgtaaaatcatggctgtccttatatttgaaattctatttacttccttttggtatgatggcattgaaaagaagaaatgataagtgtttcagatggtggatatcccaattaccctgatttgatcattacacattatacgcttgtatcaaaatatcactagaatcttagaaatatgtacaatctctatgtatcaacacaaaaataaaataaaagctaaatctaaatatgtttctttagaaaaaaggaagaatgtcagatttttaaaaggtaataataattattttataggtaaaaatatttttctcatatacataattatggtagaattgagtgttgaatacaataaaatattctaatagcaatagatttgtgggcactgtaactttctcgaagcagcagagaaagttctgtaagtctccaaccaagttttatctatgttatgtaagggttttgaatgcttttctataacatagtttgatcttttttcatttgaagcagtaaaagaaatttcaatgaagcattttaagtatggtgatagattaatgactgcatacaatttcactcatttaattttatttcaccaaattaggcttcaaatcctccagaccatctgtgaatatctggttgacttgtcagagtgcattttgcctgagttcaggggcgctgtgaatttctcactccaatttaaatttaggacctctgaacactgttcttctatatttgacatctgatgggaagacttggataagcaaaaacacattcattacctgcattccagaaattaaaccatcagcaacgtgttgctacattttcaccctaaattgacaaggaggacattataccacgatggaaaaaacacatgagcaaataggctaattaggtgctattggtttagattatctgtcagcagcaggactgtaggtagccacagggagtacaggcaggggaggaaagcaggcttgatctagattcaagcatgaaaccagcactctagaacatgatgggtgtaatctggagcagataaacagaacctgtttcatgatagcatttttgatgattcaggccaatcggatggctaggaagcaggcgctctccccaccccgctcaaactgctgaggaaggtgaaccatgcagttcatcagagggctacaaagaggtatcaacacttcagttttccatatgggcatctggggctcacaaaaccaaacagatttttggtatcaaaaatagtattgcagcctctgtggaaaccacccatggggtttctcatctatgtaacactgacatagtagaaactcaggctgcctagagcacattcagagaacaagtgaatgagtgcagtctacaaagtaagtctctgtcacttacatcatgcttcctgagaatatcacttgcaattgtgaattatgctgctataaacatgtgtgtgcaagtatcaacccaaatgcccatcaatcgacaagtagataaagaaactgcggtatatatacatatgtatgtacgtgtgtctatatatatatatatgaatactactcagccataaaaaggaatgaattaacagcatttgcaatgacctggatgcgattggagactatcattgtaagtgaagtaactcaggaatggaaaaccaaacagcatatgttctcactgatacgtgggagctaagctatgaggatgcaaaggcataagaatgatacaatgggctttggagacttggggggtagaaaaggggtgccgagggacaaaagataacatatatggtgcagtgtatactactcgtgtgatgggtgcaccaggatctcacaaattaccactaaagaacttactcattgcaatagtttgctgagaatgatggtttccagcttcatccatgtccctacaaaggacgtgaactcatccttttttatggctgcacagtattccatggtgtatatgtgccacattttcttaatccagtctatcattgtcggacatttgggttggttccaagtctttgctattgtgaatagtgccgcaataaacatacatgtgcatgtgtctttacagcagcatgatttataatcctttgggtatatacccagtaatgggatggctgggtcaaatggtaattctagttctagatgcctgaggaatcgccacactgacttccacaatggttgaactagtttacagtcccaccaacagtgtaaaagtgttcctgtttctccacatcctcaccagcacctgttgtttcctgatttttaatgatcgccattctaactggcgtgagatggtacctcgtggttttctcagcaaactatcgcaaggacaaaaaaccaaacaccgcatgttctcgctcataggtgggaattgaacaatgagaacacatggacacaggaaggggaacatcacacaccggggcctgttgtggggtggggggaggggggagggatagcattaggagatatacctaatgctaaatgacgagttaatgggtgcagcacaccaacatggcacatgtatacatacgtaacaaacctgcacgttgtgcacatgtaccctaaaacttaaagtagaataaaaaaaaaatctcagaaatatcaaaaaaaagaacttactcatgtaaccaaataccacctgtaccccaataatttacagaaaaataaaataataaaaactaaaataaaaaagaatatcatttgctaggagtaaaaaataaaacttcatcttgaagatcataacaaccctagatgagaaagcaaatatattacctgatctttttattttccatcctcattttctcttcaatgatatgtatgaagagaaatattaatgttagaaaggtaatgcaacgtgttagtaattgctctggaattgatttctctattctgttggcatttatcagaattatttaaatttcaaagcacagtctaagaattccatgagataaatcttattgtaaatgaattatattaccatgggcttgctcattatttgtgaaagtgactttatctgcctggcttattattaaatatagtttatgaacaaggtggcacatttccttctgtttgatttttgtaaagaactctgtatcttgagcggttgggtgctgatatacgtgccacgatatgtaatattaaaaaccctttgctctccaatgacattcttatcatttgaagtcatttcttaatgtttctacattatttttaaaacactgctcttttgagattttaaaattgttatttatattgcaatattttatataaattaatttactccttaggaggaaactatatagtgaacaaagattttttatttaaccttttcaaaaataatatcttctatttgggaaaaaaaaaaatgctttacaaaagaggttccaaaacccagaggggcccacagtcattgtgttctttcttgactaacgaattccttgagtgcagtttcaagtacagattgtagtatctatcaatgtcttacccaattttccctgtcagtgtttcaaatatattttaattcctgtaaaataatctgggatgtggtaacaaattatcatatatacattaagaaaatttggttcaggacaggtccactgataaagtttcctggtgtgcccgatattctagtaattccttaatagaaacctaagagaaattagctcttttttgatcatcttaggtagcctggggaaaaaaaatcactccaggtacagcatcctttcctattttctcatttcctttaacatctagttttattttcttaatgctttgtcattttgttagtattttcttaatttttttttagtgtttaatactcggcaaaggacagacatagcctgcgatgcaggcagggctgcttctcttaatgttcttttgacagtaaagattcaaaattagcccattatcaaccaacaaataaaggagagggttggaaataagtgtaatggttccggccaaaaataaacacaaggccagtctgctaaattcgtatgttgcaaaaacgtacttactacttcacttagcctttaagaaagacatgggatgaattgggatttttaaagtaagaaggggaaaaaaagcaacactcttagctcctttatccagtactcctgactctgcaaggtagattgtttcctcctctaattggcaaaatgctgcaggttttcagtccctcggtgaaagtgacttaggacggggcattaattctttcagttcactagggcgtcatttggcaaattactatatgtgagcaataaatcaaagagttcgaagatgccttgagaaattctccaggattattctcttgccttctggtaaattagaaacatactacattcaataacaagagtatacatattttatattataaacattatggctaaaaaatcatggaagaactattattattttacaaccccctctttttaaatgttttcctaaacatacatggtatgtatgtatatttcaaactgtcaaaaatccctggattgcaagtaaaattcaactatcccacttgcaaaatgaatgggttaattgttcttactttagactcataagttttcaaagaataatttaaactgttaaatatttaaaacaaatatactttatttggtgacttaatagataagagaatagaattagttgtgaacatttatactaatcaaaataatgaactactgtcattttgaattgacacctatataaattctgatttaaacatatttttacatctcagaagaaagagcatagcgttaagtataagaacccatttcaaccatagattggcatagcaattatctgatcttataaggttaaaaatatgagaacattttcataatgatattaaagtattaattagtaaaatagttgctcgattatattccataaaaatagatagacaaagaaaattttaagataaattcctatgtagtaggtaaatacttttccctcaaataagggaatacattaaggagatgaaaaattctcaaactttttcattttataaataagaaaaaaataatcaaccatataaaaaccacatgacatcaaaagctatagttctaaatgctagccatagaaatgcatgattatattatgatactatttatctgttcataaacatgacctgcctccccagtgcaattttaggaccaatgaaaaggagatcctacatccttttaaatttccccgaaccctagtgcatgggaacaatatacagtattttctcagaataaaaatcaggatgatgaagaaacggcgtttactatgcaagggctgaatacaaagggagattagtggactgtttggaaaaagagaatgattattactgtttactttaagacataaagtcagaaactatagcctgtgtgacaactcgcatttgctgcctgtgtgcgtatggcacacaagctaagaatgggatttacatattaaatggttggggagaaatcaaaagaataatacaactttgcaacacataaaaattatacgatatccaaatttctctgtgcgtaaagtttgctaggaacaaaaccatgctcattcaggtatgtattgtctgctttcatactacaacagcgtagttgagtaattgcgacaaagacgacaagcctaaaatatttactaactagcccttcaaagaaaaaaggcttctgactcctgctttaggagaaagcacgtacaaggaggtaaaaataaacttttttttttttaattgcaatcagattccagatggaccctaagagctcagttacggaagtggaaggggaaaaacagcagcagcagcagcaacaacaacaacgacaacaacaacaacgacaacaacaaaccgaagaggaaaagagagctgagtggaaaaagtctttgaaaatttagtcctaaaacttatatttacattctcatgctctcctgaagtcacagaaagaggttcggaacttctgctttaagaggacatttgaatcgactggagaggaacaaagcattgaagagagaggaagtgaactcctcagataaagctctaatatgagaaacatagttccagagagaagttaatgttacttcatttttctgtctcatttccttcaagctcaaagcatgagtaagtgataatggtaagtaaatatgtattctctctgccatcctaaaaacagaaggagggggaccacttgtaaaattaaacactggctgtaaaaataatttatccatatgtaggatttttttcagttggagaaagcacccaagcctacagagtgcgtgcctaggttctgcaataacaatgcaatagaaacagtcacaattaacatacaggcacacaaacacagaaacacattttcgtgctttcactatagttacttatgggaaaaaatcaaataaaatgagggcattggaaggcaaacaaaacatgcagatacttattttttgacaaaactttaatgtgaagttattacaactgtctgaaaatttaactctccaacaaggtctttcttgtgaaaccgttgtttatcttgcaagttcctacagattctcaattctgtacccataattttcctatcccttgaggcctggtaaagttttcatggaaaaaaatgaatgtttttgagattctacatttaatctcttaattattctaaggcaataacatctttccagtgttacagatttcatgccaaaaaaaaaaaagtttatttagggatgcgcgcagcagctgacgcctgtaatctcagcactttgggaggccgagtagggcagactgcttgagaccaggagttcgagaccagcctgggcaacatggtgaaaccccgtctccactaaagatacaaaaattagccaggcgtggtggcagacacttataatcccagctactggaagacagaggcaggagaatcatttgagcccacgatggggaggttgcagtgagctgtgaccatgccattgcactgcactccagcctgggtgacagaacgagactctgtctcaaaaaaaaaaaaaaaaaaaaaaaaaaaaaaaaaaagagagagagagagagagagaagttatttagaactaacagtatgcaaggcactgtgctggctgctaatgggagacacaaaggaatgcaaagtcatgaccctccagaggattataacctcagcggaaagacagacaggtgtacaagcagctatgatacaaggcaaatggaggtaatgctttaaaagagctagacaggggaaggagatgttacctctagtgggaaattttagatgacttcatgacaatgttgtgctctggccataaaggaaacataagacttctttttttctttctttcttttttttttttttgagacagagtctcgctctgtcacccaggctggagtggagtgtcgtgatctcagctcactgcaagctccacctcccgggttcacaccattttcctgcctcagcctcccgagtagctgggactacaggcgcctgccagcacgcccggctaattttttatatttttagtagagatggggtttcaccgtgttagccaggatggtctcgatctcttgaccatgtgatccgcccgcctcaggctcccaaagtgctgggattacaggcgtgagccaccctgcccggcccataagatttctttaataagagatgcagcaaagaacattctaggaagacattattacattatagaggcatgagagggtatagtcttgtctgcctcactctcagattcataaaccatgggaggggcctaggaatctgcattattaacaagctccctaggagattctgatggaggggttctgcaaactgcactctaagactgatatagaatatctaccaagaaatagagtagggaagagcaggaacaaggtatagtgtgaaagctataggcttgatgataataaaatgagaaagcaagtctaagcttgtggcaaagagtcaatgtaattttcagtgtaaggcaatgagtgccttgctatgacaatgttatatatttacaattaggtgaaatagatccatttgcataaaattcaaaaactggcaaaattaatctatggtattagaaatcacgataatgcttatccatgggggtagcacggagagactgaaaaggggcagaagggggcctctgaggtatcatcaaggttctgtttttaatctaagtgctggttaaagggatgtgttcagtttgtgcaaattcatctagctgcacctttatattaggcatgcttttctactgaagtatattatacttcagtaagaagttataaaaattaggctgagtaggtgtatttcaactaaaagaaaacatcctataattgttatcttattaatctcagaaaatttcataataacttaatacctctttcaattctctgaaagttatataaatgtgataaaatagaatataagaggaatgttctaaaacatttttcagatcattctaatggggaaaataacttcttaaagcttccttgctaacacttaaatcccatcagattgaaatttcttattctaaagttaccatccttgagtctattatttatcctcactgtctcagcttgctgtgccccttcacagtaaaacttcttgaaaaagttgtctataatctttgtatctattttcccaccttatattatttactcagcctactcctctggaccttccatatccatcattctgttcaaattgctcttgtccagatcaccaaaaaattatatgttgccaaatccaatagtcacttatcttttcattatactgagcccctcataacatgctggttattaattactccctcccttcaacactctttttgtatctttcatattgccacactctcttgattcccctcctaattcttggtattctatattggatgtccctcttctgttccacttctaaacatctgagtgtctcagggcttgatcttgagactatttatgttctcctggaggtctctagcgccatggctctagacagatccttaatgtgcatctgccagccctaagctcttctctaaaatccacatttatattcagtttcctagggtctctaataagcatccccaaactagcatgtccaaataaagattcttgatactttttgaacaaatctgctcttactttataatattctacatctcaataaatggtaataccctcatcataattattcaagttaaacattaaagagttaacactgatttatttttttctcctaccaattaagccttgttgactacaaatctgaaatcagtcgcttcaatctctccagtacaatcgtccttgtccaagccactatcatctctcacacggactactcaattaatgactggtctttttattccactttcaccccctacattccgttttcgataagccagtcaaagtgaagctaatactctccaatcacttgccaccataattacaataaaatctaaacaatttataaaaacgaacaagtctttatatgagctggccattgcctacttctccaactcactcatcctcaatgtcttagccatattggcttattgttgttgttgccccatgaatatgttaacttgtctttacaccaaacactatgcattagtggtactcctgcctagaatactgttccttttgattgttattataggagatcaatatataccactccaaaatatggcactttgacataaagattacttttagttagaggcaagtaagaatcaatataagcaaaaagaagccttcccagtgcttcccttgtctaaataaaagcagaaacttctgagaaatgataactgctataagccctctctcctgggaaattgttatggccatgaagaatacgaaaagttgatctcaagatagacttggcataaacaaactatactccatgtttctcccatatatttaccttcctacagtttggcaaccctaaatacctaaaccccttttttctttgttttgtcatttctctacaagtttactgttctttgttcagatgctatataaacccaacattctaaccacccctttgagttactcatcactgagtttctaccaggtgtatgtgcactgaatattttaataaacttctaggcttttcctcttgttaatctgtcttttgtcactctaactttgtaggactccagctgggcagcctagaagggtagaaggaacatatttttcttcccctacatcacagagctggccccttcttgtcattcagatctctgtttaaataacatggctcagaaaaaaatgtccttgcttgggcctggtgggtcacgcctgtaaatcccagcactttgggaggctgaggcgggtggatcgcttgaggtcagaagtttgagaccagcctgggcaacatggtcaaaccccatctctactaaaaatacaaaaatcagctgggcctggtggtgcatgcctctagtcccagttatttgggaggcggaggcacacgaaaagcttgaacatgggaggcagaggttgcagtgagctgagattgcaccactgcgctccagcctgggcaacagagcaagactccgaaaggcagaaagaaaaagaaagaaaagaaagaaaaagaaaaagaaaaaaaagaaagagggagggaggggaaaaaaaaagaaaaaaatgtcctagatattctgaaccaaagtggtcatcctgtcacaatctgtaattttaccccattttaaagtctctttatgtatattttctagttattttgttttctgtctcctgtgagagaatgtaatatccatgtcgatacaaatcatatcttgattgttaattgctgaaatcccagtgcgcccaaaattgcacgtcctgtaataggtgtttgataaacttttgttgaattctgaatgttaaaccctttgacaagtgacctgacatgatgaataaaaacttatagggtttaaggattaaaaaatttccataaagaattgtttacttaattcacaatggctaggacttgccaatgggtatagaggccaccagaaactggtgaactattttttaaaatctcataatataagaggaatcatattattaactggccactattctgagttttgaaaaacattttacaactttaaaaaatgattcaaataaagcaaggagacgagtaatgcaagtaatgccaagtatgacttgtgtttatctaataatggactttgttacttatagccacatggaattttagggctgcaaacaacaaggagaggcacctccttctgtaatcacagtgttgctataattacagacaaaggtttgtcagcatttccattaaaagaacttaactaagctgttaaatgtccattagcctaatatatggcttataatatcttagctaactgcatattaaaaacagctaattaaaaatggatggatttttaaataaagttatgtaaatacccagaagaaatcagctctttaagtgtgcacatttctataacaatataagtgcaagctttttttccccagtatttgaattgtctatttatatgcattatttttaaaacttaacctaaaatgttctggaaagggattacataacaataagcacaatgttgtcataagaaggaagaatgaacggcttgactactgtgatggacgctgatgaactactcagatttcccttcaataaagaacttgtcccagcaggtggaagggctggtggcagacagccttcagctctcagttttaggggtggtcccagccatgaagagcccccttgcacaaggtcatgacttatttctgagaaggctatcatccaatgactgattaatgcaggagtagtaaggctcactgttctcaggactactctgaagggtcattcgaagctctgaagcttcccatatgtttggtcaattgggaaacagctctatggaggtgcccaatgatattataagtatccacataggccacatacacaaagttcaactgcagattgacccacgtcttgacaaatgctctgtgatccttccaacatgggaagataggcagtcttgagaggaagtctaccaaggcaatattccacccacctctgtatctttagggaagtcccttaccttgtgggaggtggcgatagaacatttctcatctgcctttctggttatggtgagacatatgatgttccatctcagctccccttaaagtacagctgcagagtataaaactgcttaattgcatgacgaaattggcttctcaacaacagagtgcacactgcttgtgttgcatgtcatctggtctctttaattttggtatcatactgtgggacaagtgacacaggaaactgacaccatgctgatcatacttttgatgcctataaaactgtttgggttgactgtctcattaactgctgaatctctcagcctgcttaacactaaggctgttattgggcctgcattacagctcaacttctctttctgtccaatcctgcttctaagccctctcttgaatatgtattggtccagtgggcattccctgataagtattctgcatattaaactttattttagagtctggccgggcgtagtggctcacgcctgtaatcccagcactttgggaggcagaagtgggtggatcacctgaggtcgggtgtttgagaccagcctgaccaacatgatgaaaccccgtctctactaaaaatacaaaattagccaggcgtggtagtacttgcctgtaatcccagatacttgggagtttgaggcagaagaatcacttgaacccataaggcggaaattacagtgagacgagattgtgccattacactccaacatggacaacgagagcaaaattctgtctaaaataataataataataataataacaacaaataaagtaaaaataaaaatgttttagagtctgtttcccagagaacccaacctgtaacacctacttagtatgtcaaagcaaccaaggaagtcaagggctgtattatttctctttttatttggctgtcaggagttgtgtttattactctatctgaggagcccagagtgattttacgtacacgatctctttttgcagtttcatattacatgttcttagttgctttaactagatgactgctgagcaggcatctaggccatctccactgaagtcgtgcaacctcttccaatacaactccagcaggcagccaggtttggaagtactctattccattacatctaaaaagtatgccttttgttttcgagacaggatctcactctgtcacccaggctggagtgcagtggcaggagggagcacagctcaccatagacttgacctcatgggctcaaacgattctcccatctcagcctcctgagtagctggggctacaggggcacactacctcgcccggctatctatctatctatctatctatctatctatctatctatctatctattttgtagagatgaggcctattttactcaggctggtcttgaactgctagcctcaagcgatccttacaccacagccccccagtgttgggattactagtgtgaggcactgcacctggccattatttccttttgttatttccactcatttgttttattgctccctttctgagcaaagatgatgctttaacatcctttgtaaaaaacagcctttgaggttaacatacatctacttctcagttttcctacaactagatttttctaccccatggagaaatagtctcaattacaactagtcctaagatcagctctttggggctatttgattattcaaaagtcctatgtaaattgaagacctaaaggataaaaagatccctcccaaccatacctcccctacatgtgtgatgaaagcttcagctgagctagatggcccctttaatggtgtttttaatttatacctgctcttgatggaagagaaaataaaggagttctccaaagggatttaggcgtgggagtcaatattagatccaaagcaagggtcattctgttcctatgtttctaagggctttctcatttactcaatctaataatttttaagcacctcttattgtcctagctaacaccctggatgaaatggtcagaaagcactacatgtatttgacctcagacaagtaatagaaagcctattctgactttttaaataacatttcaagaagtcctgcataactcctttctattattttatgaacatagtccatggaggcttccaactagcaacccgtgaacttaacctaaggcttctatttaatgagtctgatagccacctgaataaaaaatcttttttttttttctttttttgagatggagtctggctctgtcgcccaggctggagtggagtggcaggatctcggctaccgggttcaagtgattctcctgcctcagcctcccgagtagctgggactaccggcacatgccactacgcccggctgattttttgtatttgtagtagaggtgggttttcaccgtgttagccaggatggtctctatctcctgacctcatgatccgcctgcctcggcctcccaaagtgctgggattacaggcgtgagccaccatgcctggccctgaatcaaaaatcttttgcgtagataaggaaaaaaaaatcaacagtgttgtataaggggctcatagccacttcatggattgaggtagcttacaaagcaaaataacagggaagtgccacaaaacaattcaatacactactggattctttgaaccaaaaccttgaaaacagcacaaatctgttccagtacttgggagatcaaccattgaaaattaacatttcatttacaacttctgcctgctcttctgttctagcctcctcttctgttctagcctgctcttctgtggctgttcatcgcagccacatttgtaggtttaaatgttcagattgcctagaaagctttgcatatgcaaatatatgcataatcatctggttatgctttctatcagactcataaacctgctttattctctccagcatttttcttctaatatttcataaatagggctgtaacctcaaccttaaattccaaatattctgaattttctttttgtctataattgtattttgtcaagatttttttttactaatatttaaaatgaactttaaatgtttctgaattttaatattgaaacctcaaatcctcacacactcaccttaggtaagtaaaaaagctttagagcttgagttagtaagaaggacttagtcaaggaaagagacaatacagtgagtgagtgagtgtgtgtttgtgtatgtgcctgtgtgtgtgttgaggggtcatttgtgtattgcacatgacatcgagaagtgagggatgtgaaaaccaagatgtttccttcctgaggccgtgtgacctgattcagagctgcatctcattcacctcttaggtccctggttggagtgcctttttcaaatgtctctgcccaaagtgagggacatcttttattaaaccatcaagtcaaaacgagtgatctttctaatacatacaaagactcaggatatgccatatacagacatgcaaatgaccaaggcctattttcaagcattattactaaaataattatttgggataaaacttaataaacacaagtagtatctgctttatagatagatgatggtgccaaattgaatatgaatatcagttgtttgcaatagggaacatattttccacataagcattggatacttagtagctcagttgccaattacactgccgactctaacttaagctatctaatgaggacaacagacctgctattgggattacggaattcaggaaacagtaaattcactctgagagcaattgagatcctctgaaatggggtctcggaaggcggggaattaataacagggcctttgagtatggcctcacaagttgtaaattgcttccagaggcactgagctgagaggcgcagagaagctgaaatcttcaagccacgaaacctggccccgggctctatctgcccagtaaaaggaccactgttttccttctctcaagggatccacatgggttagcacgtgtcttaagtgtttgggttatcatgctgactgtacactcttgaaaggcaagccaaattattccttcctagacaaaagcaagaaatatatgaagaaaaaagaaaacaacttgagaggtgagatacttgccacaagtttggatggacaacccttgtaaattgagcattcattgcagcatccatgcttattttaagtgtaagttatatacacacacacaaacacatatgtatatgcatatgtatgtatgcatacatatacacatatttatttttatttaaataattttttatttgtatgaatgtaaggggtacaagtgcaattttattatgtgagtatgttggatagtggtgaactttggatttttagtgtatccatcacccaaattatgtacattgtagccattaatttatcactgattcccttgcacacccccacacttcagtctccaatgcttatcactacacactctatgtccatgtgtacatgtttatacattatttgtctttcacttataagtgagaacatggggtatctttctgcttctgagttgtttcatatatatatatacacacacacatatatgtatatatgtgtatatatatacgtatatatatacacatatatacgtatatatatgtgtgtatatatacgtatatatacacacgcgtatatatatacgtatatatacacacgcgtatatatatacacatacactgatattgatggcttttctctagaaaaagtataaatctctatatttatcaaactgtgcatttacgatatctggcaatatcttatctactaaatcaaaatgtatacaatgtgccccaatatttagcaatctcagttctgggtatacacccatgtgaaatgtgtaaattcttataccaaaagacatgtaatagaatatatgtctgcaacagcactatttgtaatagctaagttatcaataaaactgttatatttaccctatggaatattatgcagcccataaaatgattgtttaataactacacacaagagaatagctgatacacaaatacaatgcactaagaagccagacattaaagagcatatattgtataattcagcaaaaatatagtagggcaaaaccaatctatgctgtcacagatcagatcggtgattactcttgggagactaatgattgcaaagaggaaccaggggtactgttttgttttctttcttgaagtggatgctgattacatgactggctttagattttgaggcatatacttgtgatacgtgcactttttattgtatatgcacttttataaaattatttaaaatagagtacagatctctaaaatgttagcataccatagttttcatctttttgctactgctatgaaccacatccagagtaaggtgtttcacgcatattatctttaattcacacaatatggattgtatggcctgtctggtcaggatgattaccctcattgcacaagtgatccagcctttgacgcaaaaaactgaatacattaattggcattcatcctttgttgttgggtgggggggaagaagcacaatcatcatcactgtggatgtgttcatgatatgaattgtcactccaagtttccttgatgctttaggagtataaagatgatgtagctgcttgaggccactcatcctagaagcagtctggagaggcatgtgacagtagatgctaattgacattcttatttgtctgtgtcaacaatctaattaaggttttttcctgcctagtagattggtctcattttaattcacagtaccaaaaaagaaacacttccaggtaaatagaacaaaaaaagtcttccgaagaaaaagaaaaagtacaaaaaccaacttaaatggcctggagctccaaaagtactttgttgacaaagaattctgtgaacacgtcatatatattattgactaaaaaacctgcaaagttcagcacaatgctctgatccctagatattttattttatagtctacacactgttaaggtttttgatgttaagaattgaaacgagagtagtatccttataaagcattcttgcctatcttaaccaccactccctttctaatgactaggaaagagtataatgtaaaataaaaaattgattcaaaattttcgagcatgaaaaaattatcatgagggaattcttctccttaacttatccactgatgtagaaacgtacatgtaattgagaaaaataataaaatggatgttgacggtatttcccagaagaattaacaaatttgaaattaagtgagtaaagctgttattcagtcattatttcagggtcttttctcaagcctctgaagtacatgtgggaaaatgctacataaacgtagcagaaatgttaatttctgcagcttattaagttagttattagcctataattcaagatctttgagtatcattaaaggacccgcacaggtacatcattttaatgacttatgtgagaaaatagatatataaaaataggaacatgatctggacgttaagaaataattttgaggttctccttactgatacatcgtgttgtgcgttggaatttttgccctgatattgacccgctagtccgagtcaatcagacctggaattctcctgatgactggttctagactaagagcagtctcatgtcctaaattggctcaaatggattgaagagacatattccaacgaggtggaagaggttttctctctcttcagcttgtagcttaaaagccaatctatgactacaggaggaataaaacttaggaattcacgagcataaagagtaaggccagtaatcaaggcatccctatacttggcaaacctggccactctgaggcttctctttggaggattccacctctgctacatctagacaatgactcagtgttatttctggatataaggcactgctgggaacacacagatgaatctgacatgaattctataatgagtttctcaggagaataatgaattttggtaatgggaaatgaaagtggggaaatgtactgtatgttatggacttgaccttcgtctataatatgggtgtctgccactcgttcaacaatccattagcaaatcatttaacttaaaaatattttatccatatgttaaattgggctactaaaacatataatgaaagggcatatagagctatgggcttctttaaggaaatacaataacagctaatattcctaggagctttatgcatatcaggcactgtgctaaacactgaataagcaatttcttaaccttcacatgaaccccatgagatagacatggttttcccccattttacagttgacgaaatagaagagatttcagccacttgttcgaggtcatttgttcaaggtcagacaggttccacggtggaacctggaaagtaatctcagatagtttctcaaattgaagctctcaaccaggaactctttttacctccagcatatattcagacatggcataagcagaggacagaggctgttctatgaagcgatgactaaaaaaaaaaaaaaaagtacaaatatttatttttgccatcataagctaaataagtgggctttcctaagtagtttcgtaataggagaaaagctgatgaataatgagatagaagggttggtgttgaggcagaggggctttggagactaaagcaaatatttaaatgaaaatagctctgaagtgtgtgtgtgtgtgtgtgtgtgtgtgtgtgtgaaaacagaagttccataattaataatctactatgtgccaaatactgccatgcacaatcactacaaaagtgaatggccttgatcctttccttttactacagagaatgacacatataaataaaccatgtcaatctgctacgacaagcgctaagattgaagttcattgagtgttcagtccgagccctaaaagaaactactgattgccacatgtatgtaaaggcaagcaagacaaggtttcctggatgagatgaggcctaggctgaaacatgaactgaaaaatgtgtttttctggagatccattcaatacgctatatttaggtatccctttgcttaaagacaaagtatttgttattggaattgatgtgtagtaaaatccgctccttttgaagtaaagttctgtgagttctgacaagggcttagtcgtgtagccatcatcgcaggcaagacacagaacagcttcatcaccccccaaaatgctcttgtgctgtccttacccccatctcacctcctcagaagcaatctcttttaacccttctactctgtggtgtattgtactgaaaataagatacgtttattttataacttttaaattaggttcaggggtacacgtgcaggtttgctatacaggtgaactgcattttgcgggggtttggtgtaaagattattttctcacgcaggtactaaacatagtacccaataattatttttcctgatcttctccctccacttgtgttccaccctccagtaggccccagtgtgtgttattcccctctttgtgtccatatgttctcatcatttagcttccatttataagtgagaacacgcagtatttggttttctgtttccatataagtttgctaaggataatggccactggctccatccatgtcgctgcaaaggacatgatctcattctttttcatggccacatagtattccatggtgtatatgtaccacattttctttattcagtctgttcattgataggcatttaagttgaatccatgtctttgctattgtgagtagtgttgcaatgaacatacacaacgtgcatatgtctttatggtagaatgatttctattcctctgggtatatgcccaataatgggattgctgggtcaaatggtaattcttttgtaagttatttgagaaatcaccacactgctttcaacgaccgaactaatttacgttcccaccagcagtgtgttaagtgttcctattaagagattattaaatccctatccttctaggaagttatttgaagtagtcaagaactacacagagatcactgagacaaagatttgaagaacaattggaatcttacagctagctactatcagaaataacaacccgtagtaaatattatgtagttaataattttctacttacattatgtttaatgagtcctcatcaagaaaccatgagtaacataaagttaataaacagagatgacatgatagaatctccaagaagttgaatcagagattaccttcaaagtttaccagaacaaatcaacagaaattgcatagaattagaaagctctagaagtccattaggaggggagttagaataccttcagagaaaaacaaacaggaaaagtgaaatttaactatctaaggaaaatgtgtgaaagacatatttaaatccctgtcactaacaaagctgaaggaagagtgtcttcagattacaggtgtttcttctacctacatgaaaacctgggaaatgggcaagtgaagagcacagatttatctctgaagaaagaaccctcccaccttacagctactagagtggtcaacccacttttaaggtggggattattcgtcagcgttatccacagcctcagggaaatactcctcaaagacatctcattccttgctccattgcttctgatcatgaagtccgtttcatgatcatcgctctctaattctaaaacttctaaccatgagataagtttctaagttaccctcacacactcaggtatccagtttctgaaaaggtagtacaagtaatgtgaatgaaagagtattccggtttggatatgattctgaattttgggttttttttttctgctgggacaatccaatctaggtgagccaacccaatgctgagggacagaccctggttaaaggagatgcttcaacacaggccatcctatgaggtgctgtctgagaggccagtcaacctctctgaaagctctgctcatgtgtttaattttcagcaacggatattgcaagagaaaagcatgctctgtcattttcctatgattagacaactaataaataagccagctctggcttaaatgtagcacttttaactcaggccatgcccatttttttatgccacacatcttctcaggcacagcgggaacacacttgcggcgtagcagcagcagatgatttttttcaaagaagagaagagaagacacctttggcaaaacagtgctgataaactaatagtcaggagctttgacagaatgttaaagaaaagctgattttcttcgatttttttcaggacaacatctctgttatccttgaattgaattcttattccacacatcaaaatccatatctaagaaacaccagagaattcttccagatacatagaaacttatatatttttttcagtgataagcagtttgattataaaagatataaaacatgactgataaaaaagcatggcttagatgttgagtaaatattgtagctaaatcctgaaagctcaacatcaataaataatggaagctttagaaaccaatgctctggataacatccctattttagaatactcaaagggctgctacagctatttttttttttggcagttccattctccacaggtgatctatagcttgaactaaacctaaagccatcagattttccaggtttaaaacattttaaaatggtcccatctaatccacaggtttttaaagttacagttaataatcatgttactgaaaacatacactagaagaaatgttatcaagacattaattaaaagtcatgttgttaaaatatatacaagacatacactagaatttttaaaaatattattcacatactaataaaatgaaagtaaggaaataatacaataattacaagaacttcaagaatttctcatagctagtagtgaacatactgatcagtataagggcttgggggtttattaatatttctgaggcataactgtcttaaaaagagccaaaagtgagatctgataatttatcagattgtctaagaaaatgttaatattcatcatctataaaatgactaacttttctttggtgtacatggttttcaagaaaacatgattcattatttcaacatttaaaatttgcctagagagcagcagcatccctgacagactggctcatgctatgattcggtgtcaggatgaaaaggctggcttagagacatgttctgggttcaatttccagtggtttaaaagatttcttggagttaggttgtgcatgataatgtgcctcaatctagaagaggcatgggcaactcccagcatgcaagcagagctcctggttaacatctgaaagtattcacccacaccgtaatccgctggtttattccacctttatgaaactcctattacatttgtccaccctgtgcttaaagcagcaacagcttaaaagagggacacttcagacaaggccccttctgggtctctttctctttcagtaccgcagagaaaaagatacaatggaagcaacagcagtagatggaatttttatttgaaacaccaccactaaatagctttcagatgaggaatacaattctttggtatttctattttaaatagtgcaggggctgggctatgagattttcatatgctatctcatttatttcatttatctatacatgtttaatttagagtgatgatgtaacattggatgtggagactccaaagctgaataatgtaatatatcaatacaatacctgcagaaacagctatgcagtggagtattttggttttatacttcctcaaaaatgttcatcacgttattttcactttttttttttttttttttttttttttttttttatagaaacacaggactggctttggagttatttaggggaagagtgcctttggtctttagagaaatcttcctggacaattcttgtaacaaataaaacatcaaggtgtaattatataaaatcactattaaaacgcaacttatttgtactatattttagctgttttaacactaagtgaccttacactcattcattgtttctattgctccctgttattgttcctttctaaaagaatgttctcccttatatactgtactatcaccactacttaattagtttttgtattcaatagtcttgctcattggcgctaacattaaagtatgaaataagttaaatataatggaaaaaataatttcttactttaatagtcactttagtcttcacaatagaattctttaaatctataactcaatacttaacagctgagaagaatatgagtgtgtttaatataaattaaagcagcaatttctgtttcataccacattttcttttcaattcatccactgatggacgtttaggttgattccatatcatggctagtatgaaaagtgctgcagtaaacatgggaacaaagctatctcttcaaagatactgatttccttttctttggataaatgcccagtagtgggattgctggatcatctggtagcaattcatgttttattaagaaagtgtttacaacacagaagctcaaaagccttcagctatctctatacaatgccattttaaacacctttggaagattattaaaatatgttaattattttgtcgaaaaactaaaaatttaaaaagcaagacaggtcaacaaaggccagattagaaattaccataaattattaaagtcataaaacatactgaaatctttgggatgtaatttaacacatgagatttacgactactcaagaagcatactatgtagtatgtcacttttgtgctttgagcaaggaacatactttgattcctctatttcagtgggatgaaaacagcttgtgcctctagaattaagacaatggcccacagaattaataatatgataatgaattaaattctctatatttcacagaaaataacaaattttttatgactgtcaataaaaccctcagatagttcaactctgtataactaacaagaaaaattagtttaaaatgtcattttaaccctcctttaaaaaaaaaagcttatctaaatttactggagatatcaatgaggttacggagaattattttaagaaatgtaaaaaggaaccacaatggttctttgctcattaacaaaatgctacataactacaagagatggtttataattacaagaggttaatcatgctttgcaagttgtaaaatttactctcttaggaaataatttcaagagtcctactgattgttaacaggttaaaaaaccttcaacgtttgttaacacattaaaaagtcttcacatatttggcctttaccaaagtaggcagtagtgaccatggtcacctatactttaatagtttttagaacaacttatacatagttcttgaaatggcaataagaattagtggcaataataaataaaacatttatgaacacacaatattgttaaaactccagtgttcacttagatatgtaatctatgtaacaatattgcataattgaagagtttgccaagataattactgatgtatatatatttttcttcatttacaaatattcatggcaaatatgtaatatcaataatgccaaaatgtttagttatttttgtgagatatctcaatacacaaaacagataatagaaatataaattaatgtttgttagagtctatttattttagatacacatctcttccttcaacagcattaagaaatacacaatctccagtgtaggacctccttatagaaaaacattctatcactttgcatagggttattcagatgtgcaggaaagaaccaagaaataattattggttatctattatactaaaattcataggcctgaagggtacatcaaaataggaagatagccaagaaatggtgttcattttcaagtatctttactcaagctaagtctgtaagtcatgtattcacaaaacgatgcttagtggcttgtggcagtacactgtaaataccaaatgagctgtataggactttcaggaaatgatggtttttgagagagtaggtgtggcaggtcttcaagggggcaatgggacttgagcaagtgtcttgtgatgatgggtgtaatttgtaccttgcatgagggtaaatggcgaacaggagagcatggggctagaaaaacatgagacaaatcagaggacagttaatgctggcatttagaagatgtgctggaggtgaattaccaaaagagtctgaaagggcttggagattattcctccttccagaggtgaagaaacaggcccagagtcgttgcataacttgatcaaataatagggccctgtctttttgaatcatcgtccactgcctcgagctacttccatttcctctattctttcactagttaaaatgtaccttttcactttgtgaaaatgacgtgagtgagagtaatagaaaatatctcgttatccatagtttcaagcctagatttgtggaagtcagaatgacagtttcttttaatataacaagttttcattgataaaattattttcagaaaattctctaagtactcttgagttggttaaagtccttatttccctccccaaagaaaatcttaaattcctcgagaccaggtctgtgtatgaatcatctgaaatcctccccaaagggatggataatgcctttgtctaaatgtaggtgcttagtaaattatggataaaagttgaacagcactggcaacaataattcacatcaaagtacattctagttctttatatcacatagaaataaagaattttcttataaattttgtaaatgtgaaagaaaatagaaccaatttagaaaataaatgtcaatcttgcattttaattgttgctcctttcacattaattttacaaaaacttgtttctgatttgattttctatggattaaaagcattctgtgcagttggaagctcattattaatcatgacaactgtagtggctgctagtatgaattaagcacatataccatgtgcctagctaaatggcaagccattcagatctctttctactacagttgattataagtttttttttttattatactttaagttttagggttcatgtgcacaacatgcaggttagttacacacgtatacatgtgccatgttggtgtgctgcacccattaactcgtcatttaccattaggtaagtttttaagagtcaggcatgatatcttagccatctttctatccaaaatgcatagcatgatccctgacatgtgtcatgtgcaatccaaatttaaaaataataaatcccctaccaaatacatttccattaaatatttcacatgagttatctggtttaatcatcccccaaacctcactttacaaatggagaaacaaaagtttcacaaatgtaacacgcccaatgccccacagatagaaagtggtggagccaaggtttgaacccaggctctttgactccagagcccctgcaagaaaatacaactctatgctgccttgacatagctcttcaaataaacagccattcaattatgctcagtgatttcctaatagtttccagaattctagccatgagaaaaataatggttactaatttgaataacgtaagaattatattaccaacaaaaaacgggaggccatgcttaggagacactgtgataacagtagaaagctcaaataaataatttttttaaagttccaagggatccattaaaaaaatacaaaaaaaaaaagtccatttctaatattttattcacagtgacgggcctgagcataacataaactgaaggctcttaccatgttagaaaataaacttaaagtagagatttcactggagagctgaggacccaggtaggtgaggttctgagtgcatctaacagaggggttattagccacatcattcaatcacttaaaataagactatatacgcatagcattagcgagtcaaccatcattaagacaagcggatttttcggagactttagcatgagtccagatgaccaaactcctctgctctgcagatgccatatgtaatgcagatttgcatatttctaatgtattcaggtattactgtttaaaatctactagaataacgacagctttaataaaatagagtttgaatggcttcaatagcaaagaaaattcttaaagattcaagggttcaagagtagtctacttagaaataatcatttaacccccattaatgaacattttttttggatcagtatctacagttctttttttaaagttttttaaattttaagttctgggaaacatgtgcagaacgtgcagatttgttacataggtacacatgtgccatagtggtttgctgcacctatgaacccgtcatttaggttttaagccccgcatgcattaggtatttgtcctaatgctctccctccccttgccccccacctcgcgacaggcctcggtgtgtgatgttcccctcccggtgtccatgtgttctcattgctcaactcccaattatgagtgagaaaatgcggtgtctgtttttccattcctgtgttagtttgctgaggatgatggcttccagctttatccatgtcccttcaaaggacatgaactcgttcttttttatggattcatagtattccatggtgtgtatgtgccaccttttctttatccagtccatcactgatgggcatttgggttgataaacatatataaagatcactttcttatcctaaggaaaagtatacttgtataatgggaccagatatataaagtgacttagttaaaatacaaatcaaccctaagtataaaattaaagggaattctaaatacaacatgtatatggaaatacctataataactaaattcctaatgttgacaaagcacttgacagtttacaaattcttttactatatcatagcatttaataatgttaatgaagtctgtcacgtaggcattttgcatgttttacagttcagaaaatgttttcttccagtaaatctcagctaaaaactgctgaagctagggcttgaacatctgtcttattcccatttttaacacggactgttacattttcatctactttttttgactaataaagtcaatatgaaagtcagtctagattcaggctttgcacatcttctttacaatgctagcgagtttggggcaaccagataaacaccaaaagcactcaaagaacatgaccataaattaaaaataaatccataataaattcagatgctatgctcttcaaggaaaaaaatcaaaaaggggtattgaaaatgtgcctgtatttgcgtgatatatgcatatatatgtacgtaggtacacatatttgtaatttatgtgtatatatgtatatagtttatggatgtatatacatgtaaatgcacatatatgtaaaaatcatataaatatatagaaataaataaagatctatagtaccattttagagaaacaataaagcataatttctggcaaaaaattaaagttgggtataattcaaatatcagtccattatacagaaaaagtaaaagtttgtcctaccttggattttactgattataaaatgaaagcacaaatgattaaaatttctagttttacaccaggtactatactgatggcatgcccaccctgtcttgctaatagtccagttttcataaactaccttgtttgaaaatgagaattttcatgtgaagtcagggctccacattggaaaacactgatgtttctaactcattctagatatttcattctctctttctacccatgtaattttagcattgcttgctcctagcacaatgtttggcacatacttgtttcttaatacaagttctttaactcaaacaatataatcatctcagtaaattcagtgccatacccatactttaccttctcttattctcccggggctaaatatgatcacttcaatcagaatgctcataaaacaaaatcacctgattaatgcaacttatgttttcatgaagtttaaatcaaaatcatttggtttgtttcatctcttcattttaaaacccttttaaaatagattagtctactttattgccttggtaaatatagaatgttgaatattaattttaatcattgctaatgattggggtcattaaaaagttccagaatcgtcatctttacaaatagtctctgagtatactgctgtgcatgttgagggcttaggcctttaaatttgtgaggcaaatctatggcctacagtgtgccctatgaacattgcttttaggaataaattgatgttaagaatgtactagtttacaatcccaccaacagtgtaaaagtgttcctatttctccccatcctctccagcacctgttgtttcctgactttttaatgattgccattctaactggtgtgagatggtatctcattgtggttttgatttgcatgtctctgatggccagtgatggtgagcattttttcatgtgttttttggctgcataaatgtcttcttttgagaagtgtctgttcattgtggaaggcagtgtggcgattcctcaggggcctagaactagaaataccatttgacccagccatcccattactgggtatatacccaaaggactataaatcatgctgctataaagacacgtgcacacatatgtttattgcggctctattcacaatagcaaagacttggaaccaacccaaatgtccaacaatgatagactggattaagaaaatgtggcacatatacaccatggaatactatgcagccagaaaaaatgatgagttcatgtcctttgtagggacatggatgaaactggaatacatcattctcagtaaactatcgcaaggacaaaaaaccaaacagcgcatgttctcactcttaggtgggaatggaacaatgagaacacatggacacaggaaggggaacatcacaccctgggaactgttgtggggtggggggaggggggagggacagcattaggagatatacctaatgttaaatgaagagttaatgggtgcagcactccaacatggcacaggtatacatatgtaactaacttgcacactgtgcacatgtaccctaaaacttaaagtataattaaaaaaaaaaaggatgtatcctaccatgatgtgtctttttcctaggactggcataaaataaactaatctggctcacagacaatttcagtttatcctcatttttatcaccatgtgacctcgggcataactaaacatgatctaattttatgttacttctggattcaatgcatttgcctctctctgagatctatttgtaatcaaatttgttaattccatcctgaaagggagaagtaaaaaggaaaaaaagttaacatctttctaacatttcaactttgaactaccccatccccagaagaaactgctattaaagataagttttgaaaactacacaagggccttacattatcttgaacatatatattatttacaagatcacctaactttcttcctcatttaactgaaaagctttcagatagcctacttttttctcacataagtagatgaaaaaaagaaagaaaatcactgtgtattattttcccagatatatatatatatatgtatatatatatatattagctactacggaaaatgtaaatgcatttatctcacaaggaagtttaaagccttggagccatgttttctgtattaacacgtgttttcatcgcttcttcctccacaattgttttttagatttacgctttttcaaagcataaataaccccagtttgtcttcagctgcaatgagaaaacatagcatggtatatatctcttgctatctgtcaatttgcctattaaaatattgttcaccttttctttggagggtttttcttcgcctcctctttcctgactaaagtttcttgcatcccgtgcatccgtcaaaggcttagctttctgttttgtttgttcaaagcccgccttttgggagcttggtcccatctttgcttccctcctgctatcatctccttctaagcattctgtttttagcttcacatctcccttcgccatgcttcttttgcttagaacaataacgcagcagcaagtacatcgattgctttaggaggattttatcttgtactcagttccatgttcctattcattcatttgtctttatttctttaagtttctcgaggcaaatatttagtgttacagatctatgcctacgagttgatgtctggttgccagaattttatcagatacatacacagctcatcacagacaatgtgattaacacttctgcatgaattatgtaaaatgttcgtatcagagtcttttcatagtaaagatattagtgatattatgtataagtgtttatatacattatattttgttatattttgttgcagaacatgttctgagttttcttcttttcacctagatttggagttttaatatggagaagcagtggtggtttaaaagaccacagaatgatgtcagacaggccagagttcaaatacaggttttactactctatggctctatgagcgtgagtaagttaccctagcctctctccagctcaatttaggattactacgaagaagctcggaaacctcacacagggaaaagtcatgtagtgggcatagcacgattagaactataacacaccctcaattaacgttgatacctgctcttattctcatcctcaccattgctattgtaactattttctccccttgcaattggttcccagaatttcacataaactatgaatccagtttgaacttaatatttattgaattattttcttctaaacatttctaattttcccatttcttgaaaagaacttttaccagatgttattcatattgaattgtaaatttaaaactattataataagctgaaatatatcccttggttagaggacttaacactttaccaatataacaattataatcagtaagaacattgcttctatataacattttattacaattttgctatagtttaaatgtgtcccccaaatttcatgtgttggaaacttaatccccaacgtggcagcaccgggagattgtgcctttaagaggtgattgcatcatgagggctctgcccttatgaatggattcatccattcataaattaataggttaatgggttatcatgggagtaggattcatgattttataagaacaggaagagagacatgaacacattagaatactcagccttcttgccatgtaatgtcctgcactgcctcagggctctgctgtgtccccatgagcaaaaaggctctaacaagtctacagccacaccagcctaaacgcgcccactcttatctgatcttggaagctaagtgaggttcgacctggttagtacttggatgggagaaggctctgaccagatgtggcccctcaaccttggacttctcagcctccgtaactgtaagaagtaaactccttttctttgtaaattacccattttcaggtattctgttacaagcaacagcaaatggacttagacgaattctttcacagtataagattttattgacacatagtgtgttgaataaataacagaatgatttcatcttttgtaatcaaaattaagtttgtattagtttcctgtattgttcctaactcattcaaagatcaggtggatgaaggacagactggaaaattttaatgactttacttaaataagtcatttacttatttaaaaagtcacatatttaaatgaataatttggttgtataacacagttactttagaataaaaatattatatctataatattttaaagtaataaataggaccataggctatttatgaaatatgacatgaatttagaatttcgagacaaatctatatttatttaaatgggcaatatggtttgagaacagttgatatgaaacacgatgatgaacccatcttctgatgaataagaaaaacactcaattggcaatggagctgatcatgcattcattgaaattaaattggctttaagttgtactagtcttcttatgcaacgagtagctccttattttgatgaaaattccccaatttataactaagactggatcttgttattttgatcagagatgcaaatgtctttggaaaaaaagttgggggttcttaatcacatgacttatcactgagaatttataaaaacattttatccccttgtagaaatcgatctcaaacttagggaacatataatttagagaaactatttttaacccaacggagctgcatttaggttactccctgtgattacttttgaacttggtagcactcttcttggttagcactgttatttggagacaatatcatacgaggtttatcttgtaggacatgttcagtaatttcctggatagtgttcaaattattaatagctaatcattattccagtgaatataatacagtgtactttaaaagtcatcattatatatatgctaacgataaatgaaaaataatcatacgcagatatgagaactataatgttggaataaagtgcttcattgctgccccacacgcgttagcacttgaataaatgtggatataaagtagaaagaaatattaaatatcaagtgttattccaaccattaaaggatttttactaagagaagaatctttcttcacatgatgactctataacttagctgaaaacaaaagcgcataaatggcctctcctgaagctatgtcttacactccttctgatgacatttcaattataagccgaagctccacgaaacaatcgattcctaaaggtctaacaattgatcactccgtacactgaagtgcctgtaatgactactgtttataaatgttttgctttaaaaaataaggcacactattaataaacagtttgctttaatagaacaaatgcaagttttcaaaatatttatcagaccacgactcttcctgactcagattggcttcagatgtatgtataaggaaggcctattatattcgtaaacactgctaagttgagagacctgtttctagatcccagtaaatagttaagagaaattcacatcattgatctggttgcatcagtttcacacagtgcacaatcttatataaccttttttccccccagtggctattcatttaggatatcctttagaacaaaagaataggattgagtgtcatttagcagaaagaagggagctaagctgacaggcatagtgttctgttgcagtattttgtgttttcatcattggacagcaatgactacagaaccggccacggcagcaaacccctcagagttcagggcttgggagtgggggagtgggatggacaacaactgaggaggcagagacagagaactgcttagcaaaaaggaagaagaaatcaataatgattatcttctctccttgggctactgcaactctgttaatttaggcatgatttttgtactacatattctttgaattggaaaatatatttttgatgtatttcgggaggtaatacataatccttctgataagcaatatttgttgagcattttatctgctctaattatgtcaggtgctttgctacttcacagtaaccacatgataaagaactatgaatagccctagcttagaaataaaagtaaaaactagagaggtaaagcaacccacccaacatcatatacatagtgaagaagctgccaggactggaggccagatttgcctgtgtcctctaatgctaaatgtgcacagggcttagagctgttctgaattctgtaatacccaatgtctccctttttagaaccaacatttagtaacaccctcatttaccaccctgaaatgaaatgaatagatctcataaacttgtctgcacagtgatctaaccatcatataaaaaagaaagaaaataattcataacacaacaatatatgttttattttattttaaaatactttgaaacgtgtgaatgttttcatggccacaccagaagacctattgaagatgccagacacttgcgcctatgttaagaatcccctttaatgtagaatttttcaaatgtcccctgaatataggtgagttgtatggaacactcaagtaccatgagtcgcaaggctattaagtcctagttttctgctatggaaaagagctcctaggaaacttctagaaattgttctataattgctgcattcttgaaaaattcagcaactatcaaaactgcatttcctctcctgtctccctgctccagtaaaaaacatccacacaaaacacgctttgtgtttatatgttaaatggatttacattctaggggaaattaactataaacaaggttttcctctatttgaatgtgcaggggtatgaggaaacactgtttacgcatcatgaagagtctagtcgcttaccaacacacgttagtgccagcagtgtccacctttcatcataacaaccaaaaatgcctcccttgttcaattcagagagaccatattccagcagaaacagaaatgcctcaggtaagaattgtaacattaagagaacatatgcaaagatctcagtgcagtacttttgcactcaacaagcactaaataaatggtagctattagtgaataatgacaattctatatttatacagaattgctcttacaaagcttatattaacagcttaaacagaaattgtaacatttatagcttaaaatgaataaagctatgtgtgatacattaaatgatttaaattttaaaaactgtaagaattaatgtggaaaactggttttaatttgagttatttcacatacacaaatgtttgctcttatacacattttattgcccatatgatagaggtagactttcttctaaaacaatcatattaatgatttaaacaaaaacgtgagtttaatatgcattattattcatgcttcataataatcacctgatctcttcaaatttaactgtcacacaaagctcagttccttttcatggctataaattacatttcagaactttgtgtctttatactgctaataagtcatatttgataatccagcatataataaaaggatcgtgtacaacattaattacaaggtcagttagatgtcaatgtagaaactcattgaatagtatttttgtggaagtagctagactctattatgtttaaacttcaccataatgaataatttgtatcagacttaattcacgagagaaaagtgaaagttctgcggcaaagtggctttttctcccgaaataatgttaataattgaaggctttcaaaattttttcctgcaaatttcagatgtgattaagtgttgactttataaaggctggaaacgtcaaacactttaaagtaaaattgtgttttcatcttaatttaatgatgaaaaacatacttatgctgtctaatagatctaaccaagaatttctgattcatttgattggtctacctggaaaataataaaattaataaaggagagtataaaatgcatattctgtagtacataaatgatgtgtcttttaaaatgtcaactgaaataatattttttaaaatgaagccatttaaaaatgatttttagtgtaaataagatgccagaagatggacaggtataaaattaacctctacccataaccataatttcatagtagttaatgagctcaactcaagaaaaggatagaagtctagtcaggaaaagggtaatgcaaagtgaaacattaaagttaaattatttccctcatttttggtaacaggttattaaaatagacttgaatgggtttttcaatatgaaacactaggatgagctttctgtgcttcagtttcttcatctgaaggagaggctgtctgagtaggggaccataagaatccacttcagcttctgtagtctatgatatatctgcatttttatcaggcatttattattattcccatgtagcagggaatgttctgctccctcccttgagccaggaagtacaatttgtatcaggatctcgaattatgttttgctccatctaatcccagtcatttctctacatatctgtatttttcaccatacttaataaaattatagggatttcttcttgttctaccacttcacttcatggtctccacttgagtaatgcaatcaactggcaggtacaattaccatgaggcagagggaaatgtttcttaggacccaggcaaaactgatttattttcctttgtgccaaatcttacatgtacttttacaccaagttaacctgcttaggcaaagggaggagccatctttttcaagctctgcaatgatccttgagaaagcagaaaagtcaatgggatctaatatttttatggtgtgagttccatctggggacatttgtatggggttgaagaggaatgcatttgatgaggcagtgactgtttgatcttaggtaccacgttcctcagtatgtgggagtgtaaagcttcatgaacaaattatttttagttgagctaaatggctatgagttgatcattaatgattaggaaaaagagccaggatggaggattacgctcttggccttgaagatctctaaggcagtagaaagagtaataaggagtatattagggttccttagagaaacaaaaggaataagagaatatgtatacacacacatatataattatatgtgtgtgtgtgtgtgtgtgtgtgtgtgtgtgtgtctctgtgtgtgtttgtatgtggtaagaaattggctcatgcaattatggaggcaactatggagactgacaactcccaaggtatacagggtgaacaagcaagctggagacccgagagagctgatagtgtagttccaatcgaagtagagcagacttgagatacaagaacagctaatattgtggttaaagtctgaaggcaggaaaaagcccatgtcccagtttgaaggcagtcgggcagaacgattcccttttgctcaggggagggtcagtgtttttcttctattcaggcctttaattaattacatgaagtctgctcacattaggaagggcaatctactttactcagtctaccaatttaaatgttaatctcatctgataacacttgcacagaatcacccagaataatgtttgaccaaatatctgggcaccttgtagcccagtcaagttgatgcacaaaattaaccattacgggcagtgttgacagatcaaagtagtggtaacagtaggtgcaaagtgaacaacagtatcattagaatgtccagggactttttcaattccagaaacatattgactgggtttgatgccccataactttacaagtaacaactattccacatgatactcaatgctcatatgactgccttggaggaataattgacattctctaccccctgtcccaaactttaaaaaacattttgtgtactgaaatgatttaggatgaactgtgaccggaaacaagaaaatagtaactcacggggtggtccaagcaagatgacagccaactttttgttctttgttttgttttagattcttaacgctttagtgaagttggatccacattttgatcattgcaaatattagaaacaacttacatgttcaacaaggtaagattggttaaaaaaaatcagcacaaatacaacaaaatactatcaggtcatttaaaaatgtgaaagaatgaaatttaagagcaaagaagaatctcatgctacagagatttctcttacaaagaaagtcatctaaattctcatggatagaatgcaatagattaattaggaaacagtatttatagaaacaggattgttactcgttaaattgccataaaattagaacaagaacaaacactagcttaaaagagaaaagtgccttttcctgaggacatgtgatacaatgatggcatttacagaaaaatgagttaatgatactgagggactggcaaaaagaaaggaggccattttcatggaaccaaggaaaactatattcaaaggtggtatcttttctctgctattggttttataatcatatacctatagctacacttaaaaattaaaatacttacagaaaatataactttgatattgatagtctgaaactctctaccccaacctcttctcttaatggataattatgtttaagatggttttttaaataacgtgaggttttttattagttaagaacacaaggagcatgttagaatacactgcatgttgtgaagttcagaaagcctgttataaaagagcagtatcttattgccttttcataaacatacgaatgtttaaaattcatatttatataacaggaaaaaagactattaggaaatgtttgaacatgaaaatgtatcaaaatgttaaaagtggtttgctggggaaagtgatattaaagaagatatttataattttttctctatgctcatctatcagcctatacatttttcataataaaccaatattatttgcatattctgaaaaaagtgttatttacttgttagctaaaatttcatgttatttgattcagactgtgtttcttctgctcagtttttggaatgctctctctctacactcaatctatctgagaagaatcaacagctacaatacaattttttttttgcatttagagactctatgcgcccagaataattctgtgatatgtatttctctttatctaaaagtctatatagacaaggggctctgatacatggtttcttctttaagccaccatcgaacatgctgcaggaaagttaatcgtggggatatccaacagagacctgtatcaataacataagaaaatgggaaattcacccgatacttttatttcctagggtgaaaaagaaattagagccaggtaatatctggtataaaaataggtaatatcatacaaaattcattaaagaaaatctgagtgcggaaattaccaaatcacagaatattagagctggaaaagacattgtacagatacagaaatttgaaaaaaaaaaaatacagagatgaagtgatcattctgctgtcctcacagaaatgcctgctacttctattgaattttcctctcatcttcctttaagcatttctggagtgcgtggtgtgtgtaatcataaagttttgtgttaaatgccaaaaaggaggaaatcataaaagagcggtgtaatttttctattatattttgatagtcctgccctctgcataattattttgtttctaatgtctccaacataatctcttaaacatttcttaaaatattttttttatcctaaatgcgagccgactaaggcaacttcttgacaaacacacgtcaaataacaccaacatcaaaatctaaccattcacatccatgaggtaaagaaaaccaaattaaccagtcattatttttcaatggctatgacttttataatagtacagcttagtttctatgcatcctcctatattctgagattcagcgttatacattttcaatttgattttgccagtcaaatttcatttgttcttgtttgattggctgtcgtttacctattaggtgctgccttcaattcatttttacattctctggggagacaacctacacacgaaggttttgccactttaaatgtttaattctgcaacacgttgcagagtaaaatcttcctcgatttatcctatagaagtttcctgtgacaatgcaagtgaaaaaccaaaactcaaagtgtggcaagttggagctaaggctgatcctggaatcaactagtttccacagtaaaaaaagaatgagaatgagacatagattccccacttaaatccaatagaggtagttttcactctgttatcatgcaacagtgtgtgatagtcaatgttgaagtcatataaacaagttatttggttttagcatttaaaataaaggagttctatcaatttgtggtaaacacaactacccatattgttctcttcctttagactctaactggagaagagagtatattttctgcctcttttcccaggtaatagcatttataggatgaggagctggctaatggcttcagttccacatggctagctacactagggggaaaaaaaaagcataatgctgcaagcaaaattccgatgtagtcacaagaaggacattctatttccttttgaaaaaatgtgtttcaggttcttgggtaaatctggtggtagaaagtttaccacctataattctgtaatgtgatcctcctttataaaattgttattacttgtggcaagaaaagaggaggcagatggtactgtgtcagatgctgaaaaagaaagtgagcatctcctagaatattacagtggaagtatccaacattgaaggcagatctctggaatacaaattcagaagtaaataaaatagacattctacaaacagtgaccaaataaatgtctggactgtgaaacagtttatccattgtttacataagaaataatgcggattatattgcatagctagtatgtaccccaaaccaacaaatatattttaaaggtccatcaaacagcccaataaggttccattttcacatacgcatgcagcattttataacagtcctaggatatgtgtatatacagagggatggaaaaaatacagttttaaaagacagaaatttaccctacattttattgccatctgggcagaaacacacgttccattcttttcgtttctccgtggcttctcccaaagagaaataggcctgtttctttaaacaatttttttataagcgctatcccttcttgaagttgagtatagcataacaaatttactaaaatttttttcttaaggataacagtagaataaagaacaatgagccactttgttacagagataagccatgtcattcttttggtttataatgtatttgcccaaaagtattatgtggctagctgatagctgcatagactaactacagctttttactatttgtgatacaccaggttccctttaatcaaacttcagttatctgtatctatattctccttaggataagcctagattgtctaaatttagagcttgctaccaccccagacattctttctttttggttatcatatcaagtcccaactgtgcagcctggaattcaatgtcaaccactttccatacctcacacaatccctgtgattccatcagctctgaccgaatcataataaacaacagtttattatgatgcttcaagtcccatctctgcagcaagtgcttctccaggtgatttaattaccaataatctttttaaaatctgaaaccccagtcccgtttttgcccattgagcagaggctaggatttattatacagaggatattgttttattatctatggcaataaattattctcttgttactctatagttatatattacattctgcaaacaaatttcagatacctcaagggcatgaataatatatttgattagctgatttattggcatagaatgcatttatcgagctttaattatgggccaaaaagtgtactacgccctgaagtcagaaagatgacaaagaaatgttcttggctttcaaggagatcccgtccctcgaattcattctaataatttttagaagagagttaaagaagaatgctctagaccagtggttctcaaactttagtgtgcatcaaattacctagagggctgataaaaatacaggctgctcatctccactctccaatgtttctgatcaagcaggtctgagatgaggcctgaggatctatatttctaatgaattcccagatggtgctgatgttgctggtccagcgaaagagtgatttagagaatggaaaggcaattaaataggcaatgcaaagacacaacgaggtagagggccaactgtattcaagtagcagcgggaaggtcatatggtgggtttagagggtgcatagggtgaccacaacatggcacttggagacgaatagattataataggttttggacatcatggtaatggtaaggaatgtagatattagaagaatcatcatcatcagaaatttgtaaataacggagggatgtgatcacacctgggctttagcttttagaaagaaaacaatagggcagaggatatgtctacacagaggattgtatcatactgatatttagaccacaaagatgagatttgattttctttcaacactgagggctaggtatcatgcttcatatttatggtctgtctcagctttcctcacctggccaattttaacaacctcctagggaaatcacagcctccagtccacctcctctctccctcccataatggcaagtagatatctggaatcccgctattaaatagcatcaacatctgaattcatgtgtttcaccgatttctcaggctattatagcaggagaaactcatgttgtaattttacttatcaggaatttgaaagccaaattagttaagtaaattaaagtaacgcagctagttaacagcagagtcaaaactagagctcaactatctcaatattgtgtttattagtataataaacgcatataaataaatgtaactatttaattaattgacaacaatatgaatagttacgtttgcacctgcacaggcaataataactaatgcacagctgtgacaccatcacctatgagacgtatctgttttcagaaatattaaaaacaaggtgcatccagtagggtgactatagttaatgacaatctattttgtatttcaaaatagctataataaaatacgtgaaatgttcccaacacaaagcaatggtaaatgtttgaggtgacggatacagaaatatccttatttgataattacacatggtatgcatgcatcaaaatatcacatgtatcccacaaatatgtacaattattatgtatcaatttaaaaatgcacatcttagttgcaataaaatacagcaaacacaggtgacttttcagggcctcgatttcgttcatgggaagaatgaaagatgacatgactctgatgactttttccatgccctatttccaggcaacagagtgtccttctaaaccagaagagttcagctctaacacagaagactattataaaagttagactcctttgagagcattggctgttctttatttttgtgtatatcctttcctttctcgatttcacaagcaactcctgacgattctaggaatttattgtccaattttaatttcctgatcatagttatagctttgaagttcattatcaaactttgacctcatgccctcattcctacctctcagacacaaattatattattacagggatatatattaatatttcaacatttctgcctttcctaaatccaaataaaacaatagaatactgaattaaattactacgataatttatcattgtttctaatattttcttgttttttttctgagaatgtggttattgaatagactacttttttgattatgcaaggctcaatgtcaacattttgttgctaaattataacattaagtaatccagatcacacaatatttttctttagctaagaaacatgtttaacttccagctacaacattttctcacagaataagaattacattgtttgtatttatctttagcttcagcacttattgcagttataaaatatgttaatatcatgggcataacaactgaaagcgtacttaattgttcaaccttggggaccacataatctacatcagatttctatgggtttttcatgtctctggttatgattgcacctttccaatttgtctctgtgcctcaactctctctctccccttatccatcctgtgtagcccttctaaaaagaatctttgaatatatacttttactcattttatgatcgcctgttcctccagctagcttctctttgacctcattgactcaattcaccttatgcctttcccctaatatcttgtgtctaatcatgtgagacttcttaatatttccagggcagaccgtcctcttttgtcctttcaaggttattcaagctgttgtccacacttctgatgttctccctctataatgacaagcttctactcagcctcccagatgagctaatctaccaccttctccgtgaagctgggtcttacgctctgttggagaagagactactctgattccttcacagattttactgtacctatcttgggatactataatgattttgatgctgttctacctgactaaacccagctgttactatttagcaatggatacaacatagtagatactcaacaaatgtcttttaattagtgcatgagcagcagtatctgcacagtgaaagccactgtctgtatatcctcacctcctactacattttaacctaccacaaatagttttttgatgcatgcttccagtgaaaatgtcttttatcaaggtcaagtatgagctccatattgcaaaacccaatggtctattcttttgtgtttgtctaattgtattttcaacatttgacactgtttttgattctatcatgaaggactttcttcatcccacttgcctggttttctctataaatcacagaagttgcttttgtctcctttgagtattttttttcttcctcctgttttgaaaggtgcagtcaattctcgggctcttttcccaaactctcctcctagaagacttcatccagtcccatgtctttaaaaaccatctaagggcctatgactgccacattatttatttatttattttgagacagggtctcactctgttgcccaggctggagtgcagcggtgtgatcacggctcactgcagccttgacttcccaggctcaagtgatccttcagcctcggcctcctgagtatctgggactacaggcatgtgccaccacacccgattaatttttgcgcgcgtgtgtgtgtgtagaggcgaggtctcgctgtgttacccaggctggtcttggactcctgggctcaagtaattctcctatcctggcctcccaaagtgctgggattataggagtgagccactgtgtccggccaactcttacgttattattccagtcacagtatctgtcttcagcttcagactgatctacccaactttctttccagcatttccacttggatatctaatgagactctgataataagagagactcttgatttcatcacaccttgtaccctaactttttcctcctccacttttccccagcaaagaacttagaaataattctcaattattctcatactttacatctaattcatcacagcaaatcctgtcagctttgtctttaaaatgtatcctaaataccagctctctaactgaccccaccactccaccctagtctgaaccacctctgatgtggactagtaacgtggcttcctgtgctatctccctgtattcactattgcttccatttcagtctaacctctactcagcaatgatgaatgaactctttgaagaaagcagatcaggtatctccactctatttttctaaattcttcaatgatgtcctgtcaaaattatgaaagagttaaattcttttatcacggcctgcaagatcccgtgtgatcttgcccttgcctatacttgcacctccttccttccccaccttctcttacactggaatccttgctatttgttggctaggtcaagtctcttttgaactcagtgcccttgcccttgtttcctctgcctggaatgtttttgcccaaattggagaatatctgctctcatatctgctcaaatactgccccctagagaagccatgccaatccacccaatctaaacaagtccaccttcaatatcattttctattcccttaaccagctttatttccaatatggatcactatctgaaatcatatgtgtatgcatataataaataatatcatttattctctagctcactactagagtgtaagttctacgagactagggacatacttatgtattcttgtatcccaagtacctggcatatatcatgtacttcacaaatatctgtggaataaatgaacacattgaagagatctacattatgccatcgtgatgtaaaaattgttttgagctaaagccatttgaggatcaacagatacgggaaggggctttttctgtactccccctatctgcctaaaagcaaagatttctgaaataattcaactgttttaaatcctcctttaaggaaagtttcttgcaccaggggtaaagagtgactcctgtcaccagagatgagaagttgtcgctgggaaaagaaaattacataaacagactttactaaaacaaacattacctttcattagtttctttcatatttcccaccaactttgtggcttgaaattctaacactcttcttttcaaaacccttgttaaaatagtacataagccccaaattctaacttcattgagctatgttttctgtgagctcccacatacttctctgaataaactttgtcttttctattgccaatctatctgtcgtcagtttaatttgcagccccccaagtaatgaacctaagaggggagtgaaaaagtttttcttccctgacaacacaaatggacacatcaataaatggatagcttgagtaaatttcctcatgtttctaagcctcactccattacatttttattgatcacagcaccagtgccagacgacaaatgggaattcttaagagaaagggcattagaagtgttaaaaggcaaccacagagagctgtcacatggagaaatggtccatgccatcttcatttgatctcactcctagttgggagtcatcagaatggggaacggagatatctttcagcaaggaggtcccagtgatatgattaataaaaatatgtcaaaagacacatgagaatagaagttcatttgatacaagcaaaggttattgtttattctactaatacggttccacagaatccaggtcccagcagtgccccctcttagaaggacaagcctccctagttttcaagtcttcacaaatgtggctagctgacaaaataccatctgatcaagtcataatcttctcagatccttcataaatcttcttactgccatgctcatgtttttaaccccttccaacctcttcgagctgacattaagtagcttcttttaaaaaccagcagaaggttcatgaatgcatatgggagaagagtgaattttaggtcaaattcccaggctatgatttaaccttgtcgcaatttgtactctcccaaatcagagaggaagcctgcctacagggcacttagaatctaagaaagtgccttcggtggagaaaatatttaaccaataggtttgtttgggggatggtttggatagggatcttctatatggacctagaaggattatcatcagagacaaagagtatgtgaactttctgttaatgcccagagatgtgacaaccagagaggctgggcagaacagaatctcagagggcatgtggagcaactgagaagactataaaggcattgtgttttcttacctcaagttcacgtaaggcttataactgtaaaatcatctatttttggattatccatgaaattctcaatcctaggctagcagttttctgcaacttacaagcccatgcctctcctacattcaaaggtttccaataacattacacccagggacaagaagtatattattttattggcctgtgaggtgggggaaggggacaaaatttatataataaagtatcctattttacacagtaaagtttattgctttactttattaaacactgatcactgatgatctgttctatagctttcccaaaaccctgtgtttctggattttcaattatgcagagaaaaaagtgaaatctcctgagctggcagctcttcccctccatcatagttcaaaaggtgacagggaatagcagcctacagagtgaacagaacataactctctgagccatggttaagctccagcaattttggtggtcgcagtaaacactgggctaaacccaaggaacttctccccctctatgtggctttggttatatattgataaccaaagctgatattgctttggttatcaaagcaatatcagcatgacctgggaacttattagaaaagtaaattctcaggtctcaccccacagctaccttatcagaactcctacgagtggggcacagcaatcagtattttaatgagtcacctggaaattttgatgcaggatcaaatgtgaaaaccatcgccctatagcagcaatccccaaccttttcggcaccagagactggtttagaggaagacaatttttccatggatcaggggcgggtggggttgtggggagaggtgcgtgggaggcgatggtttggggataaaactgttgcacctcagatcttcaggcattagattctcataaggagcacacaacctagatccctcgtgtggacagttcacaatagggttcgtgatcctatgagaatctaataccgctgctgagctgatagaaggtggagctcaagtggtaatgctggcggccctgcagctcacctcctgatgtggggccccggttcctaacaggtcactgacctgtactggtctgtggccccagggctggggacccttgctctatagtgttaaaagccaaaggaaagcgggcagatcacttgaggtcaggcgtttgagatcagtctgggcaacatggtgaaaccctgtctctactaaaaatgcaaaacttagcagggcctggtggcgccagagcacctgtaatcccagctacttgggaggctgtggcatgagaatcacctgaacctgggacgcggaggtttcagtgagcttagatcatcccagggcacttcacctggatgacagagtgagacagttaaaaaaaaaaaaaaaaaagccaaaaggattagagcacagaggattggcagtcttgagaactaacgtaaccctatttgcaaggtgacagtatgtatattgaactgtatcaggtccgcaatgcagcctttcgtataactaggctcctagtgcggttgtatgctaatcctagtcctaaaaccaagattaggcaaaaacagacttgagattcatttgagtcaaggtcccattactcagtaactcctgagatgaacacaatgcccatatataactaggatctccggtgtaccctcatcttctgatactgcctccttctcatttgccttgtccactgtgatgtggccctttctgtcttccatgtagatgcataaagccctataccaagcactgcaaacatatagctgagaaggtcctcagcctccagaaacttacttttgtcttaaccacatctgattgatgtttatctatgggtctttatgcgaactgtttcttctttctgaattacccttccctgctttcattcttcattttgggactgattccacagccctgggtggccatcacaccctgtggtcacccttttcagtgcacagtcttgcaattacttgattatacagctgacttgccacctcaactaggagctggttgaagggaggggctgtgtctttcatctctttatcaccagcatattgcacagttcctacctatagttgatagttgataacttttgatgaatgaatgaacgagaatcagacattaaattttcagaaggaaaaaacagtttatccttaaacaaatgtgtctggattcagaagaatcattttcccttcgactttatgctcacaaatgtgttgggattcagaagaattccaaccttttcatttgccttgtccatgttatatggtttcttatagcctagctaaagcagtggttttcacagcatgatcaaggccagcagcatcagcatcacctggtaacttgctagaaatgcaaattctggacctgcaccaaagttactggaccagcaactttgaaggctagcctagcaatctgtggtatagcaaaccctccagctgattctgacgtgagtactactggcctagagttgcttctaagactttggtataactaccagtcagaatctaggtcttcacacacagacactgattcagtaggtttgggatgaagggcaggcagtctacagcctttatcaagctgcccagatgatgctgaaaggtgttttatggattcagaagagtctcaacacattcgtgagcataaagttgaagggaaaaaatgtttaatgaatttgcctggggttttgttacttcttccactcctaacttcatttataatcaaggccctaagcagctggtttccacttaaccttaccaaactcatacaaattcagttgggattatttacaacttccagggttacttgcaattgtatactgagtctccaaggtggttaatgagccactttggatgataacaaccaccttggctgataactaaattgataggtaagcaatgtattataatagcaaccaaacccttgcttctctgatttactgacctgtcacagatatggaccaaaccaaatttctgaaattctggctgctcaaatcccaattgcaacctgattgaggcattattagtattggagtttgaagtaaataatacaaatgcatcgactgaaataggtagagaacaagcccggaagtgcaaacgttcgttagaagttactgatttgtgcagaactctgtgtggcttgggcagtcacttctctttgtcaagtaaacatacaaaacgtttgctccttccaattgcaatggtatccatggtagatacgtgcaatgcatttgaaaataataacttgagatcgaaagacaaaaaatgaatacgctaaggaagtgtggcagtcacaaagaggaatgtatctagttcttaatcagggcagacctcaatattcacatttttagcacaaaagccaaaagggagggttgaaatttacaagtcccttcatcttggttaggctctgtggggagttctccctgcagctggtgggctgcttcctgcttctgatgtctccacctgcaggtggtggcactggcccctgacctcctgaaataagcctgttgatcttctcccacattattcctgctgcctgtggactgctgacaggaagttaggggacgacaaaaagtccctcagtaaaagactcgattaagtggctaaataacgtttcctccgaaagctttcttttcaaataaggttttcaaaatatgtgtgcatatatatatatatatatatatatatatatatatatatatatatgtattcggttttattcagaatgcagaagtgtatctgcggagagcagaagggcattggaaggagtcaaaaaaaatgtgtgtgtgtgtgtgtgtatacacacactcactatatgccaaaaggaaaagcaaacaggagaaaaagatgtgttgaaatcttgacagagcacagacaacagtggcatatttgagttagaaaataaacaagggtgtgcattttagaattctcagatttatttgatttttgtccaaccactacaaagtaaggagtaaacgtgaatatgagggggtaagagaaaataagttgatttaatggtgaactagggacaaagtcctagtgttttgcatttgctctgtgacccaggtcttcagcacctttccttggcaagtcaggatgatttttaactagctcctaactagctttcttgtgttagttctgtttccttcgaatctataggccaagctgcagaagggggctttctaaaattcaggcctgtgaagtcattggccagtataaaagccttatatggtttttcctatagcgtagctaaagcagtggttttcaaagcacgatcaaggccagcagcatcagtatcacctggtaacttgctggaaatgcaaaatctggacctgcaccaaagttactggaccagcaactctgaaggctaacctagcaatctgtggtatagcaaaccctccagctgattctgatgtgagtattactggcctagagttgcttctaagactttggtataattaccagtcacaatctaggtcttcacacacagacactgattcaataggtttgggatgaagggtaggagtctacagcttttatcaagctgcccagatgattctgtaaggtgttatctggattgcatttagagaaatgctggccacagtctaaatagtatctgaaccactaaatacatctctctgtgccccctgcccaccccatctgtgaaattttttgagatcatcttgagctccccgtcacagcacagtgcctgcaacagaactgacacattcctctctaaatgtttctgaataaataaactgcactttggcagacaaattgcaatccctaatgtgaaccttttttctcttatctagacaaatgaggcaaaactactctgacagacttcagtggtagtttttaaattgttgttatttaaggaatacactactcataaggacttttcttctcacattgaacattacaagataaattaaaataattttatctaagtaaatgtcctgacactaagtttagccagacttcaccccttaatcggttttctaaaacacaaaaagaaaacaaatgacacctacatggaaattttacttttgaaaagcagtgaaagaaagcagtgaagacgctttgaccttgagtaagattacagcctctggtccccaaatgagacatgtgtagtcttaccttgtctcaggtaaatgtgtgttcatcttgtatacatacataccacatgaatacaggaaggggaatactaaaacctagtaaggtgaatggttttgtgagcatgcatatatatatatatatatatatatatatatatatatatataaatgatcaaaattgatgctaatgaaaaaaatctgtcttgttacaggatggacctttcttcccgtggttctttaacttgagtgtgcgttagaattgcctacagggcttgatcacagatctgcgggctccactctccaagaatttctgtttcagtaggtctgttgtgaggctcaagaatgggcatttctaaccatccccgtgatgctgatctgggacccacactttgaaaacaactgctctactccatagggggaaatgaatgtgtcaggaaaaaggtgctctgtttctgaagaaagagaaacatgaaaggttagacaaagaatataaaggtaactgaaatcctcgaagtaaaataaattccacctcttaactatacctataatcctttgtttcacaggccagcctaaatttaccactttatcttatagagttgtctgtgtgaatccgctttcttatgatatagtgagctcctttaaacattgtggcatgctttattcatctttatgtctgtcatagattagaagtagtaagtgttcaataaacatttgttgcgttaaaagtattagaaaggaaatagactgtacactttattctcgattggtagaaattttatggtgtaatcctaaggtaaggtacactattgatttcaatgtttgaattttttattttattttctatctaaaacaattcacatgtgtaatgaattaaacatctgtcttttgtgaggtgatacttaaaaaatacttagagacacttaaataaggagcataatgctgtagaaataccatatatggaatctattcaatttaacaaaactttatattgagcttctaccacatgcctgatagtatactcaatgctggaaatatctaatataatgatgttaagagcttcaatttattgattagttagcatacaacaggcaatctgcaaggtgtttacagcaaattatgcttatttactcatcgcaatacctctacgaagttggctttattagcatctccagattaaggaagaggaaatcaaagctttaaaacattaatttattctaaatcacacagctaagaaatgacggaaccatgattcggaccaacgttgtccgaagctagagtctgctttcaacagctctgctgtattgactcattccgaagacagggttagcccttaggaaagccacatgcaaaagagacccaattactttctactgtttaaacctgagcgaaactagggttacgtttacctaggtccaaagtcctaatagaccccaaaggggagctcttttttggatacatgtcaggaacatgttaaggtacaacttttcattcatcaattcaataaatttctcttgaatatttgttgtgtacaattactgtggttctatgaattcagtggtgagtaagtaaagaatgcccaatatctagtgggtgacacagataataatcaaatcctcacacaaataacatgtaattacaaactgaattaaggatgaggagaggaaaataaagagcactaggacagcatgcagcaagaggacttaattcaatttgtggagggggtgaccagggaaaccttcctgagcaagtgacaaccgatcaagaccggtaagacgggcaggaaaacgtgagtgtgtggagtgggtggagacagtgagcagattccctgacaaacggaatagtacgtgcaaaggaaaaagagattacagcactgtagttagagaaatctaaaaaaaaaaaaaaacaaagttagtgtagttggagtacagagaatgagcagatgagagggatagtaaaaaatactgccaacatagcaaaggacagactatgcaaagctttgcacaccattttaaggctaaaattaatgtgaaccttttgaaggagaaatctagccaaggctagatttatatttattaaatatcacactatctgtaggcagaacagtctggtgggtaggggggttactgtgttaattccaatgagagacgatggtagcttgcactaggatactaatgggcataaagaaaaactgtagagatattgagaaggttaaatcagtaggaccaggtgacagatttaataatggtagttgacggacagtgaggaagagtgaggaaaaaaaatccagacttttggcttgcttaactggatagtgtcattcactgggatggaggaacctggatgtgtatcgggtttgaaggacaaggtcgaacattcagtttggtccttgttgagtctgagttgcctctgatacatttaagtggagatgtcaattaggcaggggggtatgtatataagactagcattcaaatgagagtttcagggctggagatgtaaatattagaagctttgcagaaacattagttaggttaaatcaggaacatagataagattacctagggacagaagacaaagtgaagaaatgaaaggagatatcattccttctttggaaccttgtgtagtgaatcagaatcaaaccctgtttaattttaaattacaaagccaatctaaccactcactgtgtagatgaagagaactgaagtcctgcgagttttatccatttgctagattgtaaaagtcaagctggggcaagaactcaggtcttctgagctgcagtttaattctccacctttatcgatatttcttaaaatgtggtcctggaaccagcagcatcagcatcacttatacacttaaaaatgcaaatatttaggccccatcccagatctactgaatcagaagctctatggctagggctcagatgcatattcaggtcagagggctcctgctctattttgtgtaatccccttcctgagtgttagcaaagtgatgggttcacacttacgggtagagaggtagcaggaggaaagtgaagctgttcttgactctgtgccagaagagattacagaaactgaccctctcgaactcaacagaagctgtagaccacattggtacatgtgttttataaactacaatcatgcatgccgtttctgtgctttgcaaaagagacagatagtggtgccaggggaaaggacattagcagtccaagttgattaggtaaaatggtctgacacagtgaggcaaaagttgatttggtaaaaacttgacatagacggcactttcaaccatcggtatccacttaatagatgtaaacagctattttcacgacacaaacacccacacttacatctttagaacagtctcagcaattctgtatgcttgccagataaatctctgctgcaaattatcctccagccatgagatttaaaaccaagagtttctagtgttttgttcctttgaaatatgtaaccttaaccagatgtttataccctgggtcacaaaaatctaattgaatagttcacttgatgtgttcgcacaattaagaaactcttcttccttaataggggaagaggggcaaattcatatgtttaattttcaaaaacacagagcgttctctgctctacaacagtctatcagctagaaatgtctattaactgtctcttctctacttcatgagcacaaagataagttgtggttttagggaccctttgggggatattaagagatcttgaggtaaatgctaaaccaaacagtttagtttgtattcaggacagtagacacgttttatatactatcatcctactttaacattaattatattaaaaaattcttcttttaactgggctatctaattaataaggccagcaacattccttgaccaatatgcttgtataagcttagtttatttttgtgtataggatttatatattcaattgtactgatgaaaaaagtatcaggagcttctgatcttcctttgtgacagtgagaaatacagaactctcagcacttaacaactctgtccaaacccttgcactaagacttgactaaactctagtatggtttctagccccagaaggccatgtccctaggatgaccctagccttcccttaagtgcctgcttgagaaagctcagtgctgccaggaaaatttaatgtttgttctagccaacacacatctgttgataggactcttacctccgtttcttagaacatttactcaaaagggcttacaattgtgaacatgtagctcttggaaatcagaagtgtctctcactcaaggacctgaaagccattcttttcaaatgacatcatcaagaaggataagtcctctgtctcctgttctctgtgggaagatagaatcctaacttcaataacttccagctaacacagctggcctaatcacatttacactgtccagccctttgtacttttttacttctctaactcgaatgaacccccactccttctccctccttcttgccttaaaacaaccaagtcgcctctgcacaaattagaatggatctcagctctcccctaatttcacgaggtattgaataaaatctgtttttacctctttaatatccagctgtgtttatctctgacaatatatatgctctcaaaagcattccgataaataaattttcctcaatgatcaagcataataaaatacatcagctttgttaaatcacctaaatactcaaacaactctaccattagtatgtgaggtagctttgaaagtatttctaatttttctttctctttaatatgccacaggaagggacgaggcatttatttgaaccttcaattatatgctatcatagtaagaagatgattggaccataaatgcaaagacatgtatttgcaattgcattgctcaagaatgccagttatgtccattatccatcccttcaatgaaacaaagaccatccattttcttttagaggtaatcactactgtccaatgcaagacacagaaaataggcaatttggaagtatagtaactagttagcaatattcttttaactttctatataggtatactttttacatgcattaatttcactgtaaaacaagtaaaattatatgattaaaaagaaaaccagcttctaagattttgagaatgcattgcatacaatggtcaatgttaatctagtcaacaaagaactgttcaataaaacatgtttgtttacaaaatcagtggaagacttcctcagaaatattttatgtaacaaatgcctagggtgggctgaagagaaaaatccagtaaaatggcatttcaaaatttatattttcctttacatgcctctaatttaaaataaatatctgatatttttcatagatttagtttgtagtacaaaatcatgaattaaatcctaatgatttgaactataatttaaaaaattatattccaaatagcaagccaatcgattgacatttacaatcttctgataaatgcaaagtaccaattccctaaacatagcgttttatggtgactttttcaaaataactacatcattcaaaactattgagttgcctgtaaaacctaaattgcttgaacattagttctggagaaattttcatgatgcctttaaactctcagtgtcaaattcaacatttaggctttaaagcctatgggtggtatttatcaccattcaacactcgcatttatcacataaggaaaatatgtttaagaaagcaaaactgaaataggaactcagggtttaaaacacttctacttataacctgtgtcgttcctctttgtgtaaagtctatgacctgctgtttggaaagacaccagatatggagaagattttgaaatgcccaaatctttataacaaagcatcgaacagaggatctgaaagaaagagcacaacagaaactcaatgaaatatctagcttatcagtctgacaattaatcatatctaaggccccacctctaatctcagtaccttagccaaaaattaaataccaaggacagttacagtttgctctagatacctagaggaaagagaacctccttttcctcatcttttccatactaaaaatgtatactgtatctttcagattaatatatcagctaaaattttgttacttcaataaaccatttttgcagcataactcttgactgcaaataaaagtatatatactgacaatcctcaaattttgtttttcagctttgcttcatcagattactagaatgaggcagtgtcatgcattgattcaataaaatttccaaagtcacctaataaaagtacattttatgatgagaaaacaacaccaaaaaatagttaccaatgcttgatacctcttgagatgtggacctcttagaggccaatttgacagtcagaagagtatgagtaatgtttttcaaaagtttcatgagtacaaaattaaaatcctacaatgtaataccagcttctcttcctacttaaaggagatcataacgattgaatcaggattacattcaaataagccaatgacaaatgtgaaatgaaagagttattctcaccaataatcattgcatcctaaaagccaaagaaaaactgctataagggacttctcaatcagtccctatagataggaattggtagttcctacagaaaaaatatatatacatctatatatatatagatatggagagagagagagagagggagggagagagagagagagagagagagagagaaaattggtaattctacagaaaacattatgtccaagattttttccttggcttctgatttcgaggccaacgagtttgggtcattttaaagggcagacatcagcaagtgcctgcagtgacaaatagttattagctgcaacacaatactttttatttccaaaggttggccagattgaccaaaggagaatcttttcttctatccttcctttctcatttttcaaagactttttttttttttttttggtcccagaaacctttaagtctttttaagctggcttttttcccccttacgctttagctttgctcttttctttgaggtctcagtgacatataggtcagggacgtctttaccaatgtaatattagtggagagttataacaagggggtgaggacactgaaggcttacacaggtgcctgaataatttgccttatcactccacactggtgcaagtggtgcagaaataagagcagattatggcttttgctacatatacttttggatttacagatcaagtgtaggttttcagaaagtttgagtgttacacacaattattaccaccatacccactactatcaatgccagaattatcaatggataaaatttgtttttattattttctattgacactgagttttatatatatatatatgtgaaatcttgtttctgtataaattcccataatgcacactccatccaagaacaaacataatttaactatagatcatatcacataactcctctggttaaaaaccccaatggcttaacatttaatttataaacaaaaaaagcccaactctttacaacgtcccggaagactgcacatcatctgatgcatgccagatctctcccttcatctcctggcacttacctctccatcaccaaaatccactcacacttttcctcaagtaggctaagttgactatgcaattgcacgctttttgtttcctttgtctggaacatattctttaggtatctgcctctgtcactattcaggttccttttcaaatgtcatttcctcaaacaaaagtccttctctggcttctctgtctggtgttatgtctcaactcacattccagttacactctaccacactgctcacttttctgtataagacatattgatatttaaaaattgttattactttttaatgccaggtgcgctggctcatgcccgtaatcccagcactttgggaggccgtggagggcagatcacctgaggtcaggagctcgagaacagcctggccaatatggtgaaaccccatctctactaaaaatacaaaaattagccaggcatggtggcgcatgcctgtaatcccagctactcggtaggctgaggcaggagaatcatttgaacccgggaggcagaggttgcagtgagcagagactgtgccactgcactccagcctgggtgacagagtgagactctgtctcaacaaaataaaataaaataaaatgaaacaaaaattgttattttttaacatctatttcattagcatataagatccttgagagtaagaactttttgcttctgattcattcctgtaattcagcacctagaaaaacatttggcatatagaagataatcaatggataggtgattgaacaaacagctctttgaaacaggtacgagttttcttgttatcttaaggataaaaaattcctgaagtttagaaggggtaagtgacaggttctagatcacatagcatccagcagagccaaccattgaaagtaagactacatgcctgtctagccaaataaaatgaatttggacacattgtgatggagctagggattgtcaagatcatgtatagacatcctaacattcttgtcgcattggaaaacgcagatattatcatgtattatgagaataatttcttagtcagggatggtcattagtgatgaagaaaaaaccctttaaaactaagataacttcaagaaaatgggtcatttaatcctctgttctactgctgctgttttacacgacattctcctctaggtattacgtattcagtggaaaatatttagtgcttgtaataaagtaagccaatggccatattgtgaagtatagtgctctacactggatgtcagaagacctcagtgccagaccctgcttcttcacacagtagttggagggtaaagtcatctgagactgtcagttccgtaattttaaaatggaaaaagcatatctgtcatatcaacctcaagggactgagagatcaatggagatgatggctataaaagcacattttaaatgccagagggatataaaaatggaaggtcccatcattgttatttagggatgaaggctttttaatctatatgtgttcagtaacatatattgcatgagaaaataggtgaatgatgaatattataaaataatacaaaaatacaatattaatagatataatgcttacctataaggtcaatttgttttgacctaaatttagattaggcaacatgttgcataaatgggtgggtcagtaacggaaatgtcactctaaaaaatgtgcaaggaagcaactgtccatcatggtcaaattacttcagatgccttgaattcatgaataaaacactccatcaaattttatgcatctcaagcacttctcacacatttaaatccacaacatcctagtgaggtagggaaggaggaatatttcatttttcttatttggtgaaatgaggataatgaggcacaaggaggttaatgatagatttgaagtgaatgcaatcagtcagcagcaaaaccatggttggaatttaggttccctgaattccacttagggttcttttcgagatactacgttaactacatttcattgttggaggaatttaattcagtcatgtagatacagatgctcacaacatcttttttcatcctactaaggaatcttgctgctaattcaaccactgagacaaataatacgtggacctgcgctggagatttggcttcggtgttcattcaagtcatttcctgagctaacttctgttccttttcctatgaatactatattttttcacattataccactgaattattcagattcattgaatacccttagagttattaacatgttatatctaaaaaaattactgctttctccttttggttatatagctagaaagtcaggatatagtaaaaggagacccaaaatgtaggttttgaaaatagaacgtcagtttttgaggacaccacacacttttgtttttcttcccatctcattgatcactccttttcttttcttttttttttttttttttttttttttttttttagatgaagtctcgctccatcgcccaggttggagcgcagtggcacaatcttttggctcactgcaacctctgtctcctaggtacaagcaattcttctgcctcagcctccagagcagctgggactacaggtgtgtgccaccacacccagctaattttgtatttttagtagagatggggtttcaccatgttggccaggctggtctccaactcctgacctcgtgatctgcccgcctcggcctcccaaagtactaggattacaggtgtgagccaccatgcctggctgatcattccttttcattatcctgtgctgttttctcctttgtcaatccacctcttaatgttagagtccttagtcacgttgtcatttctatctatattcttccttagtgatacaatctgatatcacagctttaaatgttatcttatacaaacacctccgaaatttaaacgtccaacctggaccttttttgctgaactctaaaggtatttattcaattgcctattcaatatatctggtgatatgtctaacagatatccaaatttaatgcctccctaatcgccccattctatctatagtctttattatttcagtttagggcaactttatcccttccagttaatcagagcaaaaacgttggagccattcatgactccatttttctcccatgccccttatccaattcatccagaaatccttgttggccccacttccaaacacgttcagaatatgactatttcttatcaccctggtctcagtcagcatcatcttctcacacttagaaagagaaaaacgtccttacaatggcttcaaaggtccaccctcacctcactaacattctctcctaaacctctctcacttacttcactctagccacactgcagataaccagccccaaacagcagataaaccgatggcttaggaattctgcattgactgtttactgaacccaaaatgagtttactgctgatatctacatgattcaaccccatgcctcattctttgagatctttgctcaaatgtcaccttctcaatgaagaataccatgataccctatttaaaattggaatgtactccagcatgagccatctcttattttacccttcttcttttttttcacagcacttatcacttttgaacatactatacaatatacttatcgtatctgtctttcactatttgagacccccaagaatccagagggcatacatcttttctgctttgttcactgacacattcaaaacatctacagtagtggctgacatatggtggtggctcaataagtatttttcaaattaacctgatgctaagtccagaactttcaactgcccagtcacagagctagcttcagggcatttaaagaactgaacaaacagataatggaagtgggttcatgtagatagagaagaaattaaaagaattctcattctcatgtagaatgagaagacaatggggaatagggatacacatgtcctttttttttctactgcaggcaaggcacagaagcggggatgtaaacaaaggagacatccgtgaagatgctaatataggttttcacaattctaaaaaaaagataaaataaactatgtgtttaacggtgacatggttttaaagagttgctgaatgatcagtctccctttccttttctttcttccagcgctatattatttcaaagggtcactggttacttcatgggaaccagacgttgttattgccacttgtataagtcagatgaataaagagaaattcttgataaatgaggtatactttgaaggcaaaatgttcagaaaatagggtatatgtgagatgaaaaagtatcctcagagatgaaaggatttgccaaaaactgatataaattccatgggtgcaaacagagttctaagcctactgcaataagatttgactttattggattatctatgaaatatattattgtagtaggggtctatttttatggccacatctggtctagacttcacaaaagaattacaatgggaatatactctaccaagatgccaaaaaacacatatctcttcattcctgaaagatattgcctagactgtctaaatctgaaaattaacaaggattctgtaattacttcattttcatctacatttccccaaactaaaaggtatcctagattatttgagctatagatgtgtttttatgtacagctttttaaattaatagtccactagctctatcggttacagcagtaataaaaaaacttttatggaaagttctctgagactaaaagtgatttacatgcaaatatatggaaatgattcccttcttaaaacagtaacaaaaggtgtgtttgaaaattcatgctttggaagaataaatgattttcacataatcattctagtaagttgtttatttttattgacatgcatcttttattagctatttaatggtggttcacaggggtgagtgcactggatcacgcctgtaatctcggcattttgggaggccaaggtgggcagattgcttgagctcaggagtttgagaccagatggtgaaacaccatctctaaaaaaaaatacaaaaaattagctgggcatggtggcgtgcgccagtagcctcagctacccgggaggctgaggtgggaggatcacctgagcctggatggttgaggcagtgagccatgaatgcaccactgcactcaagcctgggcagcagagcaagactttgtctcaaaaaaatgtgatccacaaaaaacaaatttaagttgttgaatattttaggctagctcaaatacttaactttaattttctattaaaatatataccttatttaatgctaatggtatctaatttgcagctatcgttactatacacataaactgcacaaatcaaaataaatagaaaacaaatattaataaaatttagtcattaacccttctggatgacatgttataattaggatattaattggaattggcattataaaaccatttagaattcgttgtattaaaaaaatctgattccataaatcatggggaattttttattttaatgacccatgtattagacttacagaaaattgtggaccttaagtaatgttttattaaaatgttctgctatttaatttgtcatatttaaaaatagctaaaatcatagttttaattttagtaatatttttcattgtgttctaagtaagccaacccttaaacatcaaatgctttcttttgggatatgtcttttcaacttctggttccctcaggtttgatccattgacattctaggcactgttggtgtgtcccacctagtatataccagccaggccttctttatcatgccccctgggcaaagaaaaactgattccatttatactagaataatatcattgttgtcactacttattacctaggcaattggtcacactctactcccttcttatggtactttcattaaggcatatgttcctttatgaaaaacattccattcctggcagccgaagtcaatctacaaatagccaggtagcaaatcaatgcagattacaagagaaagtgaacaagcaacagagattaaacaaaacaaaacaaaacaaaacaaaacaaaacaaaacaaaacaaatgttagagattgtgacttgaacgtggcacagcctagttccttgttctgccttgtccttcaaaaaacagggtcattattttgtgagattcaaactggttttgaaaattaatcatctcatggtatacaaattctaatccaccgatggatgaagtagaactttccatgtttcttccactgccacttagaaaataatattgggaattgaacaatgagaacacatggacacaggaaggggaatatcacactctggggactgctgtggggtggggggaagggggagggatagcattgggagatttaccttaagctagatgacgagttagtgggtgcagcgcaccagcatggcacatgtatacatatgtaactaacctgcacattgtgcacatgtgccctaaaacttaaagtataataataaatttaaaaaaaagaaaataatattttattatgtacagcgtgcattatcagcacagataacataaaactttttttaaaaatgtgggtttattctagatttttaaatctatgaggcttatttagaatgctgaattaaactatacaagttaatcttgaagaaccagatattggaattgctgctctcattaattcctcccacctgatttgtgtatgccatcgccagcaaaccacatagttggtgcctcctttacaaaaaaaagttgtgctaggagacaagcataaattacaaggtcagaggaataccttcaagaatcttaaacccatttgaacagtatagaaacctagggatggaaaaaactctaatagaagaaaactacaagaaccaaaggggtaagccagtacaacctctgcaaaggtaatcttactccatccactaaacatagcattatatgtttagtcactcacacacaaagatagtgaatgactgataaggagaacctggccaggcattaacaggggatggcctttcattgagtaaaagatattccttccagagtagagctggtaaagccgaagagaactgtattcaaatgaaagtatagttttttttttcaactttaattttggactagggagtacctatgcaggattgttacatgggtatgttgcatgatgaaaagcaaagtttttgatttcaggtttttggagaaacaagagtgcctcggagctgtccatggtgctgcatgagaccaggccttcattctgcagaattcctgcctcttgaaaattctctaggccctgacttacaaccctgtttgctgtatggttaacctgccaaccctgctatgtcccctataagtgattatttaacataatctataatttcagtactaaatatttcatgactaattataacagctctctatgtttccctgggtgatatcaccacacattccaatttggcagatctcggtgggcccaggaatttgtatgcaaatatacatcctcatataattcttatgagggactaaagtcctgcttagactctagtcttcccaaggtcgcccaccttaatcccgagccaactcgtccccagttggagacaagagcagaaattttgattccacaaagctgtttgattaggcctcacatacatcatctggaatcacacaactgaagcttcatttatgacactgctacagtgtaccaattcctttccctatatattttttctttttttcaaatcctatttatcctacttcaaatctctatagcaccatatttagagtcattcagatcttgatttgaatcaataactacattgaaacaactcacttaaccctatattcaagccttcatgaattcacctgtcaaatgaaaaaaataacacctacagctttgcagaattattttcagggtaatatgagacatggtttctaactcagctagcacattatctgatacacagttgctctacttgcatgtgagttctgttccctttccttctctaaatcttttttaaattcttgcatcatttattactttatttcatctaatgaactcttgtttctatcatttgtctcatcaactagctttccagatccttgactaataaagatagatattgcatactaagtgtgtggtggatggttgccaagacctgcacagagcactttacatatcttggccatgaggactcaaatattgagaggcagagttggaattctgaatctcaagctacagctcctgtcatgccatactacagtctattaccattccatttcctccaactgtgcctaagctaagtgcctggtatgtggattaactgctatcagagtcttttttactgtaatggagtagatgcattgtctatatcctatttgctgcatccacataattatcagtccgttcaaaaagcatagccaattgctctatcacttagtaaacgactaacttagaccactggacggaactttttttggaaaccaaaagaaaacagctcctaaattgctgtacctgctctcctcagattattatgtgctggaaaatcggagacgattattcattctcatacacttcacattttccagaatggaaaattaagtagcaaaggcagatgtcccctgttggggcaacgattgagctggatatagaagactcatatcctgtttgctaaactgggctgttcttactattctcaacatgttcacatcatcataataaaacaagcgccccttaagacaccataaatattacaatctcagtcaatatatttatagagtcaggaagagttggatattctcatattcatcaactgtaattcatcaggattattatagttagggagggaaacccaaagttatgacactgaaagacatgatcagtgagttttaataactcaaaacatacttgctatataacacaggaatggcttttgacacatttgtcattactttataaaaataatcctttaagttactttgtggtgatgaaacacttctttatcttgatagtggtagtaactatataaatctatagacatggttaatgtcatagaataacagataatgactcacagtaaaagagcatgtgcaaaaacaggtgaaatccaagtaaggtctacagtctagttgattgcactgtgccaatgtcagtttattgggtttggtaatatactgtatttggttaatatgtaactggggaaagttgggttatgtatacacaggaaatctctgtactgtttttgcaactccttgtgagtctatgaatatttcacaataaaaaaatcttaaaacattcttaaaactttatagaaattttgcctgccttcaaagagactgtaagggaaaatagagaaagaagagagaaaattaaaatgtctggctaattcctaataggaagttttctttatttttatacaagaaacggaaaacatagttgctatatcaacaggattttagtctattttcttcacaaagctgaagaaggtgtgaatgacttttctctgtgcaagtgaataatatactaaaattacttgttccacccttgtttttgtcttgtttacatcctacttccataaacctgccaatatttagtcactaatcttaagctatgacagaatttaaaacagattcaatgatatgatttgaattcaccttatgtaagatattgtaaagcaatatgatgccacaacacacatctagaaaactgtgtcttctctcaaatggaactgagttgttcctaagatgtttaactaaagtgattaaatgggctgaattataacatattgatttttaaatggtctagccacatttgcattgttaattttttacaagattgcaccatagatataaatcactgacaaaatattttaaaagtagcatacaaaaatcgtcaacactgggataaaatttaactttcaaaattaaaataatcttagaaaattcagttatccaaaggcattaagcaatgacttttcaaagttgataaggatatagtttctattgtgaaagtctattagacaagtacttttcaaaattatataggttattgtattagtccgttttcatgctgtgataaagacatacttgagactgggaagaaaaagtagtttaattgaacttatagttccacatgactggggaggcctcagaatcatggtgggaggtgaaaggcacttcttacatggaagcagaagagaaaatgtggagacgcaagagcagaaacccctgataaaaccaacagatctcgtgagacttattcagtaccatgagaacagtatgggggaaaccgcccccatgattcaaatgacctcccactggatccctcccacaacaagtaggaattatgggagtagaattcaagatgagatttgggtggggacacagccaaaccatatcagttattgaaggaaaaatggaagcaaggcattttcaccaccaaattttgctcaaacaaggcagatataacctgcagctgcagaacaattaggtttatgtttttgagaagtttatagttaaaaacatttgatacattgctctgcatggtacataggagttttggtcacctcattgttaagcccattactccctatgcagtaacatttaatatttttaaatgaataaaaataaggtcaggtgcagtggatcacacctataatcccaacactttgggaggctgagtcgggtggatgacttgaggctaggagttcgagaccagcctggccaacatggtgaaaccccgtctctactaaaaatacaaaaaaaaaaaacaaatagcctggcgtggttgtgggcgcctctaatcccagctgcttgggaggccgaggcacaagaatcacttgaacccgggaggtggaggttgcagtgagccgagatcataccactgcacttcagcctgggtgacagagcgagactccgtctcaaaacaaaaacaaaaacaaaaacaaaaacaaaaacaaaaacaaaacacgttaattctcttctaaatggcctcagtgtgctctctttactcaatggcaattagtatgcacaaccccaaacctgcaatttttattctcctttgctctctgtgcctcctaaaacatcttattcctatttttaaagaactatttttaaaattttatttataagaaaaaatccagaattcaatataatatagagtgcaacacacacacacacacacacacacacacacacacacacacacacacgatcttgcatggtttctcaaataatagacactcatgtagaaagccttaattttaatttaaaaattaacactctggaagttacacaagaaatgatgggccttggggccttttgtgaaaatggcaagataacaaggcaggacaagagagatggagataacagacacaatgaatatgtatcagatttcgttgatacgttcattcttttttctacaaatagacattgagggctcactatatcccttgcgctgctacacacgggggatatgctgatgcaaacactggcaacataccttccttcatggtgcttacatcataattgcagactcagacaaaaacaaggcaggaaacagaaacaaggagctgagctatagaataatgttagaggatggtgcaaggggggtagacagccctctccaggactctccttggagaggattacctacccaaagccctgaggctatatagaagacacgattgcagaggaggatgtctactccagagagacactctgcaaattgtattaaaacttcccacatcaagggggatttgctgactctccttttgtttgaatattgtcagaagactacataggaaatggtccatccttcctcaccaacctttacggcccttccatcctctgagaaaaagagaggttttgacaaagggctttaaagtttcattgttttacttgcacttgctgagtccccttggggattttatctacactatccatctcacagaaaagtcgagagcattaagcaaagtaacggttaagaatatgcactgaatatcatcccttcttcattaacacaggacattataattttaaaacatctgactaagtccatgataatatggaaccattcctatccttctctgcacaaaggaggagaaatatctgtacagtctttgaacttagttagatatgggtctgaatttcagatattttactccatgctacgaccttgcaaagcttacctaaattctgaaccccaataaactcatggatacattaaagtaaaagctctgtgcatgcttgttagaatagcacactatacatttaccaaatggcaaagtgcctggcatggagaatgatagttatagtcataaacactagcatcgtcataattgaagaaattactgtccatgggatctagtcaatcattgagtattcactcagcattcaagactgatattttatctgaattccacaaatcacccttcactcaacacggttttcttatcatcatccttcaggtagagcccctccatcctatctctggatttgcatacactgtttggaatatctttaccattttcttttcatcagatatcgacaacttttataggtctactagatcatgaaatcaagggttatgttcatgtattacttggtttttgttctgtcctcagcacccaccacaaggccctgtatttttaaaggagctcaatataaatatattgaatggaattaaatgccattgctaaagttttcctcctcatgttaatctttacccgtgtaaaagaaactatcctttacctagttacacaacttcataataatttattactctgaattttcacaagaacttttgacttaaccactcatttaaaaaaaatctgcagataatcctgtaatatatttctccagcacagttcaccctcatgaagcaggcagtattgagcaagaggctaggctcactggttagacaagtaattgacccctcacattaaatccatgcaatctaaataatgaacactaattgtatgctgtaggctgccagggtctctcgctgtagttaaaagtaaaaatacattttttttttttttctttttgagatggagtctccctctgtcgcccaggctggagtgcagtggcctgacctctgctcactgcaagctccgcctcccgggttcacgccattctcctgccttaacctcccgagtagctgggaccacaggcgcccgccaccacgcatggctaatttttttttttttgtattttttagtagagacgaggtttcaccgtgttagccaggatggtctcggtctcctgacctcgtgatccgcccgcctcggcctcccaaagtgctgggattacaggcgtgagccaccgtgcccggccacaaatacatctttatatgtttactgtctactagatactgaagactgtcattcactaactggtcactgtgtataactaaatccttgtatttcaatgtgattatgaggcccaagaaaatatgtttcgttctgggtacctaataaactcttaagacttgcccatctcccacaaactgtaggcaaataattcttctaatctgcttttatttctttattaagataaagcatttgaggtcacaatgttctatggaaatctagaaattcctaaggcaaaatctaggtgacacaattatagaagatgccgcaactgatttccctcaagcacatttctgttgccatagaatcatctcaaatctgccaactttgaagctgaactcctctccattccactcatatggattctcacatgggttttagtagaaaaatttaaactattagaacatggactgatttttctctggattattaaatgagaagggtctggattccccattacttttctaattaaaatagtatcaaaagcaaagacaaaccaatcctcagcatgtatattacagagaacctgttacagagacattatcaaggccatatttttggtaaaattacttaaaatctgattgaataaaagttgcctctaattcgtttatattaatagcactttaaagtaatacatacggatacaactttaaaaagttgggatttatcttattattatgtcctgttaaaatacgcttataaggaagaccaaaaagagtacactgatgaggatctttgagaaaattaaaaatgaaaacaataataaataaaattgtcatggctaaaaagcatatttagtcttcatgatgttaaactattatgcaattaggcaaggacattcttgtctttcaaaaataaaattcacgggctgggcgcggtggctcacgtctggaattccagtgctttgggaagctgaggagggtggatcacctgaggtcaggagttcgagaccagcctggccaacatggtgaacccctgtctctactaaaaatacaaaaaattagccaggcgtggtggtgcacatctgtaatcccagctactagggaggctgaggcaggagaatcgcttgaacctgggtggtagaggttgtggtgagccgagatcgcaccattgcaccccagcctgggcaacaagagtgaaacaccgtctcaatgaatcagtcaatcaatcaatcaaattcacactttgaaatctattttttgaaagtatataatcataaatgaaaaccaaacaaaaccctcactggctaaaacaacatgatggaaacataaaagtgacaaagtttaagacccatgacacatgtatgtaagttatttcaaaagagatcactgttagaaatttgctggaagtgtttttgttactgtgaataataacacaatttttgtaatttgcaatacatcatagataaggcatatacacacataaacattgtgaatagtggtaacacattcagttattggggctttcactataatatgcctgggtgtgcctccaacggatgctaaatttagtgcatttgaagtctcttggaaaaaaacagtcccaaggagtttgaaagggaaggtgttttaagttcagcacagcatgctccttgcagcagcaaatgtgtctgaaagcttcttgctctgttgcactgtgagagaactatattaaaatgtgttaatagtagaaagaataagttcacctcaaatactatatttccttgatttttgagacaacagtgatttcctgtatgttaaaaattatagagagcaaaatacagccatttcacgctaatttattatctccatgtgaatgtgcatttacattttagataatatatagattacttgtgaattataagccttaaaatgaattcaaacatgtcagtaggaagaagctaccatattacagattcttgaaaatcacaaattgaaattacctaatgatatgattataatttaatactagtatcaaaggtatttttcctattattttattttactaattactgtaaactatcggtaggattataggagcaagacgtcaagatatttattaaccatactaattttttattggaagccatattaaatttaacctgtaaaatgagaaaaataaaaatagtaacctcatagattgtggtaagagtcaaatgaaataacttacatgaaattgctttgtaagttttatagggctgccatgttttgattgtatgatactatgtatccctactgtttaggacatctcttcctgtttaggacatctctttcatatgtgcagagacctgtgtttactgctttttttattcacaatgtggtcttttgttaccataagttaatgaaaacatttttcagtcttgtaatttataaaatgttagtgttattaacaactatacatagatgatagagatagatagatgatagataaaccgatccatcgatagatagataagtaaaggagagtgacagagacagggagagggagagggaaagggaaagggatggtgggagagagagaagtaactgagtggatggatgggtagatgaataagtggatggatggatggaaggagacaggtagacagccagatgggtatatatggatagatagcgtatgatctttgtcctattatttaacttcccttgcttcaattttagaagatataaaataggataacaagagtacctatcttataggattgctatgagcattaaggtagttaagcctgacacatactaagagctcagcaagtgttaagtatttttcactgtagttggtatttggctcttaaagaatctgtcacatatttctatacagtttttaaattcatagattagatgtagcctaataatgagagcaatcatccattaagcaccctctatgtgtctaaacgcagatgttttacataccgtaagtcatataacatgagaataaacctttaagacacttactgctctccccattttacagatgagacaaccaagacttaaagtattgcccaaggtcttagagttggtaacttgcaaaggcaagaacaatgaccacaaaaccagaacaactgacagcagagtatctgttccagctccaataattactggctacatcagttctgtgggtcccttcatgatggtacctatacctctagagtttaaaaataaattatcgtttaatttttgcataaactctatgatgtaagtcaataataattcctcttctttcttaactcactagcatactgtaataaacatccatatacccaccatgcagatcccagcaattataaactcaagggcccatatggtttcatctacatcccaccaagcgcaacccacccctaaacctagctttgtattattttgcaagtgacctaagtgatccttcttttgctgcttggaataccaagttaatgagttatttcatgtgagatagctaataaatcacaaagctgttgcttgagaataggtgtcccaatattgctgtgtttcattttcattctatgataggtagcgtttttatgatatatgtcattggcagcaaaaaattatatactttactgattgacatatgacttctggtgaacgcttaaaatacttgattttgtttttatatacatatgtatgtatgtataagcaaagatcatcccatattcctattaaatagataagttgatatttgacaaatacactgactttagaaaaaatatgaaatcaaatataaaataatacagctgtgtacggtacattgtgatgttaacataaaagaagtagtgaacaggaatttgtgtatgtgtgtatttttgtatgtcatatatgtttgttagcatagaaaaagcagccagaaagttacacaccaaaatgttaattctggtttccaactggcacttagattttctagtatgcttaggttttcatattagcatactgataagaaaggtatccttgagtcttactgtttgggtctgaattcccattttgccattttctaactgtatacactcaaaaaaatttcttcttttttttttttttttttgagatggagtctcgctctgtcacccaggctggagtgcagtggcgcgatctcggctcactgcaacctccacctcccgggttcacgccattctcctgcctcagcctcccgagtagctgggactacaggcacccactaccacgccaggctaattttttatatttttagtagagacggggtttcaccgtgttcgccaggatggtctcgatctcctgacctcgtgatcagcccgcctcggcctcccaaagtgctgggattacaggcgtgagccaccgcacccggccaaaaaatttcttatttatacctctacttcctcatttctcatatagaagtaatagtgccatctaccttactatttagaagactcaattaatccatgtaagttacttagacctgtcattttagatattattatgactacatcagaagatattatgttagtaataagaaaaacattgttaaagaatttgaaaataaggagaataagatttgttaaggtattttgaaaattaattttaaattgttgttttgttagttagtagggtcttaaaatccttcatatcacctccaataagcttctgagaaataaataaatataagactctacatatcccatttcagggatgacttacagagggacttaataaaaatgcagaataaactattgtttttgttttgttttgttttaccagaatatctcccctttgattaaaaaaaaaaagattattgtaaaagatgatgctctaagtctgctttacactggcaggccatagacattcataaataaattcctacaaaatgaaataggaattaatccttgtacaaatactatagctaactaagtacagtttctagaagtatattttgaaatgaaatttatgtatatcactggtgataacttgtactcatttaaatgcttctgaagcattctcttcagaagttaataacttttctaaaataagtcaaatcatgcaatttgacgaatataaattgcagcaattttaccattgctaaaatggtttccgagcattacaagaagagttcacttggctactgtctttacactgaatactttgatgaggttacaataataaagtgacaaagtgatatgcattttcttttataccattttctttaaaaaaaggagtccttaattttttctaagaactccaaaatatgaaagtagaaaaaggcagctatgactgaatacatttcaagaaaaatgtcattcatctttcttaaattgatctgctgagtccagcagaaatgtctccaaggttttctcgtgacgagccaaggctaaagggatacacggagccagcagttagaggcatctagtggggcaccggttaattaactttttcttctatgcttcaagtttcaatgcctataccaataccttttgttctttgcataggatattatgcaccgaaaatgaaacaatactcataaaaacagctaatatttaatgagcatgagtaattgccaattgtgattctcaacacttggcatatatcatttcattcgtttttaagtctactctatgagataagtagcattattgtgctgattttacagatgcaaaactgtggcccagagaggtcaatagaatttcaggtgtacagatataaaatattcatgaaccataatatcctaactatggtataaatataatatgccataaaataggcacgtggtaagtgtttgctgactaaagattgaagaatgtgttgtaatggagtctattaattaaagacagggaatttggacccagaaagatttggcttggtcttatattggccatctactaagacagtttggaaactttatcaataaagtttctattttagagaatatcttagtttgggttccctaaatggaggttctgagatgaagcttcatgcaaaaatgatctaatgggatgtgttttcaagaaacactggtaagggaaaatgaagtgagattgggaagggaaacagaccaaacacatatatggcataaaagcccagggtggcagtgccattcacacttctgaatttctcagttgggaacaagaaagctcacgtatttatgtgtctgcaaccagcagtcattgattaagggcttcccacacacagggacataaattccaggatagatccatctctctctttacacagaccaaataggctctggcagcctcaaggccaccctccaacagagcgattagggagctagttgttgggagtaaaagcacagcagggaaaatgttaaacggatgtgaaaggatatgagtggatcaatgacagcatctctacagagaacttgtttcttcattcaggaataaaaataacgtggaaagttatgaggataaaacagggtaatgtgttcaaagcccttagcctgggcactggcacacagcaacactcactggcactctcttgttgtgaggatggaatgtaatactgtgaagaactgacagcacctggcacatgaaaacatcagatagctggcattgccaatcatttttcctattgcagttgccggtgccgctggtggtggcatacctaaattagaataacactgctatatttaactccaaagtctgtaaaatgcttgaatacctgccaccgtctgtggaggtgagggtgctcgttcaggacctgaacaccatagaagaagcaattttctcaccatctttattgctaccatggtattaggtaagaacctcaggatgcaagaacaaaaggcagcaccttttttgctatcacatatgagatgctgaatttattgataacagtattaaggagaatggcagctgaaaggaaatttctgatatttctttcatgatcctcccagattttgacattcctttcaaaattattagtgagagcaatcagtaagtgtcttctgctaccaaaaatgtgagcccttgcttgaaacatctttaggtaagtaaagtcagcccctaggaaagcacttaagcaaaaggctagggaaagagagctatatcaggtccaaactaccgtgctgctactcctcactcttggaagaaaatttaggcctttgcaatgaaaattaatggagaagcacatgacacctaaatgttaatattaagggaggggatagggagaatatgatatatttctctatgtgactccatcctgtttcatttgttctagtgagtacatattactattatactttgtgtgtaagataaaagaaagtttaaaaaaagaaaaattgaagttattttagaacagatcaaactgcttatgagaggcttactaccttttaaaatattattttgattaaactaaaaataaattcttaaaaacccagccaaggtaagaaaagaaaatagttttccttctcatgctctcaaactaagagtatacataaattggctaagaaacggataggatgactcccctttttccagggacaagagtgggtttaggagataatccagttctctagttatatacttgtttaaaaaccagatgaggagatcacttcctcacccgtcttttgcctctggaggcaaaaggtatggtcagagttcagtgacaaagtgacaatcatcaagggagtttagtcagctgaggttatgtttctctaggcattcttatacagtcagaccatgaaacaagactactgcttccaggaaatgccacaatacctccttattatttacatttctggaagcaaaggcagcagaatttagccactggagtcctctccactgtcttctctagtacaggtagttcctgaacattactccaaatctacagagacccttattgacagatattacagagatactcaccaacatgccagcgaaacatggtttattgttttttgttttttattggctattgtagttttacttatcctcatctattttattagggtcttgttgagtcttcactatcgtgagcacctcagtattccttgtctccagaaagaaaatgtcttgaggttagaaattgtatgtaattaattaattttctcttccatcttaaaaaagatggctgttaattctatactgacatagtatctaataactgcttctttatatcttggagattttccctggcatattcaaataaatagctgtttaaatagccctgacctgtgagtatatatgcccttgtacacatgaatgtatatgtaaatatgcaaagatacaaaatgataaatacaaagtgaaaggcaaattgttaatatattttaactcattcaacagaagaaagaaggcaggataacttcctctataatttcaggttttcttcaggatgcataccacatatgggctacattacaatgttccctccaggtagcaaatatgttcaattttaaagtagacaactgtcggaaattgattttttaaagatggggggtgggcgttgagtaaatctattatgcttgtatattgcaaatgctgtaactattatttttttaaaagacttgactttcactaacaacaaattttcttctttatatgaatatactgatctcccatcggatcatagtgttggacagttcctaatgtaccttgagataagagatgctcaagggtttcattagatttttagagagagtaaaagccaggctgaaaatgttcctggattctatatttgtctcttcacttatctttttaataacactcacacacagacacatttttatactcaacttcaaataaaagtatgccctgccctttcttttgctgataataaatatgtggatggtatagtctccagagagcgaaagtgcccttaaacatttgttttaagatcataaaaactactgttatttttaaagtagaaaaatccatgaatattgaaattgtaaaatcaagggaaaagaaaatagttttaaatattttgggcaaaatcttcttaagaaaaagaatgtcctatttccaatgactctggcacgtttaaacataggaaagaattagaaaaacaattttagtatattttggaccctttaaaatttaagtaaaacattaagatgtattttatacctttactttgaatatgtgataattctcctttactccatagaatacaaaaactctgcaaatatcattatcttaaaaatgtatttgtatatatgtgttaaattgaatctttctaatgaggaaagttaacgttcactctcaggttgttcttatcagatgagtttgtagttgtattatgaagaaacaacacattccttactgacgtctctattagcttagttatttcagttgagaacaagggaaaacataagaatggtattattggagtgtattgctatacattttattcacatcacagtattttatatttctctttttttaagtttgtacacagacaatatctctggaattatttttattaagggatatttaatgattaaataagcactcttagcgaagacctttaagtgttattttttaccaaatcgtatatagcttccacatacaatgcaaacattccagtactgcagataatatacaggggtacacaggtttgaagtagtggagagactgatggaccataagccataaatctttttaaaaaaatcaccaaaatctcagctataatcttgatcatacaaaataaaaagaggagctctaaagaaataaagcaaaaaaaaaaatttataatccacattactgcaatcatctagtttgtgaaagaagagtatgtattttaaattaaatccttaatgatttgatattttgtttttggaacttcacaaccaagactatcctaaggaattcagagctttcctcacaagaccaaagcaacagtgcatgaaattgaactcaaaaagagccaccattctgtgtgacttcttggctgacacaatttagatatttatagctttacgaatgggccactggagaagaacttgaagctttctctagccaggaaggattaatgaacgtgcgcacctggtaattacaccactccatcttcctgaaagccctcacgctgcctccatggcagaaactataatgaaaatgcattgaaaaatatcaatctgcaattctacaattaaatctaaataataaaacttggtatcttttctccccacacattccagatgtgataaaacacagacagcatttaaatttaaaacatagaagctgaatgtcagcctatttttgaacatgcctcatttccaaagtaaacctcacaagagaaaaaagaggttattaaatacagcaaaaaataacaacattcaaatgtgcaacagagaacccataactgttttccctttattaaaacacagcatacaccataagtgatgcatttacttcaaagcagaggcatttcaatgattaaatcacaaccgaagtgtacaaaggtaaaatttagaagtgcaaaggtatctttatcttccaagtccagttacttgttctggctattttttctaaactcttactgaaaggaaaacctcacttaataacttttaaaaatataaataaaaaataaatcattatcttctttacataaccgtatgttaattgcaaaattacttgaactaaagagatatacgatgacatagtatgcaactcaaataacttgttacaaagaaattttcatcctaaaacttgaacaaatcaaactttttgcagtagtatttttctcagataaaacacagtatagaggttcaacctagtgtttcttaatgtgacacaaagcaatttgatattccaaggaaggcagctatgtatatataaactgagaaggctgctttcagaaaacaatcaaggttctctaagcaaagcagggttttatgataaagtttcatggtactcacactgaattttaatgactgctttagtaaagcagaaagagagaaaatttaatgtaagcactgatactaaaagttaattgccgtcttaacacacaggcgccaagattcccctagcaggagtctcttaaaaaacacctttaaacgcagaagagggcacaagctttgaaaaaaaaaaaaaattgcctgttactgttaaactctattgttccctgatggagtatagaagaaagaaatgctccaggagagggaagtggatatgaattgccccctccagaggagccaaacaaattggctgtaggaagacttcaaaagctggacgaacagagaagctcaaagaccttacagatttgggctacttgcccttgctgtgttttttttttttttttaatttcccctagaatgaatatggtttaacttgagagcaaataatggaaggatgcatttttaaatgctttgattcccagctttttattctgcctctaactagctattacaataccacttaatccggacctcagcattccaagtaccaaagcatctcctcccacccactgctcacacgctcctgcatcagaatagaagacttacagaaaagctgccagacccacagaagagcactttcctctcaacagatgtcttccagcttttaggcacacacacactcagacacacttgcctaccttaataaggtgtgcaaaaacctctttcggtccccacggatgcttttagttcagagcagccagcaatgcctccgcacaaagctttgccattgctagtgtgaagagaaagagctgctgggatgctgaatggcacatcagccaactttgtgtgtagcaaaggctctaaagaaatcctgggctgaaactctgctggatcatggattggactcaatttcactccacacacagtctgcattacctgatggagattatttctggaagcacttagggcatgtttgtctacaaaaagatagggcctttttctttccttaacaatttaaaaaatacggtaacaaaccagagacctgatactttaaggaagatcatttattgtgagctccatgagggcctcaatggtctgtttcgaaattgcagccccagcatctagaacacagtcagcacttgataaatatttggctaaatattaaatgctcaattgatatcaggttcaaattagaatttgctaaattatttacacactgtaatgaaagtaaaaaatgcaaggtttgctgaacagctccagagggttaataagagtgtgtgtgtgtatccttttgtcattcaacacacacacacacacacacacacacacacacacacacacacacctgtatagctgatgataaatatacattatatcaatgagttaaaataaagtgtgctattcattcactgagcaatggggctattgcctgggcacggtggctcacgcctgtaaacccagcactttgggaggctgaggcagatggatcacaaggtcaagagatcgagactgtcctggccaacatggtgaaaacccgtctctactaaaaatacaaaaattagatgggcatggtgacgcacacctgtaatctcagctactcgggaggctgaggtaggagaatcttttgaacccgggaggcagtggttgcagtgagccgagattgcaccactgcactccagcctggcgacagagcgagacttcgtctcaaaaaaataaataaatttgtaaaaaaagatttaagcaaacccactgataacaatacttagaaagtttgttgaaaaccgtatgtattatttgcttattgccctgacaatttctaatatcataatagttcattataatagcccattcctcagtgaatgaatagcacacttcatttgaactcattgatacaatgtatatttatcatcagctgtacaggtgtgtgtgtatacgtatacttttgaatgacaaaaggatacacacacacacacacacacacacacacacacacacgcacgcaattattaaccttctggagctgttcaccaagccttgcattaaacctggattgaataaaagactcccattcctcaaggaaattttacttcttctatgaggacttctcagtaaccctaaattcacaggcatattctttacatgttactgtcccaaagcaaaatgcaagctggcatggaaccaagcccagaggttaattcctgaagctagaggaaaaggttccaaagtgccctacatcccaaggtcgcccaacagatccacacctggaagcaatctccgccaagcgcctatttacaggcacaggtgtgtgcctatcgggacagctgaggaacacacctaatttgatagatgacattctgatgtggcaggctttattgtgctgtttatgacaatatctgcagattatgatgtgcttgtttaataaacagcgtaattaagcacacacaaaacaaaacaggaagttaatacctaagtggtgctgacgtgtttatgtaccacaactgactagtgtattctttactgcctattactccacttcttaatatccactgaaggaatcctcagtctgtatacacacatctccaagttatgaacatcaacttcatgcatatcctcagaaagacctacttacacctgcagcctcaccacatatatctacacccttaacaggcattcaataaatacttgtcaaatgatcagataaatgataaatgaaggagaaacataccaatatttatatcttcaagattgctcctatgggcatataattttacaggagttgctacttggattgtctatcttttcagtctacattttttctctaaaatataattggcagttgccttatggatagattaaatttgatagagcctggtacttgaggtgctatttcagcaccatttctgtaattctggaactagttatcaggcttggcagatgcaaatgtatgcagttttgatcttcttcccgactctctaactgcagattttacaactgaagaaagcaaggggaacttttatttataaataatcgatacaatttgtaaatagaaatcctttccctctgagcagctcacagccagccagctctcagatgaaggtacgtcagctctctcttgactaatggtgtggtctgcatcatggaggttaccagacattccttggcagaatgcaaatcaaacatcttgaatggcaaaaggatcaaagcacggcatctaaacattgctcagacctgctgttcatatttttatgcatcagaaaacttgaaagagaaattagaattgaaagataatgcacctgcaccttccaaagtgtataatattgagatttttagcatatttgtccctctgggattagtatattttattccattgtagggcagcagctgaacaggggtttgtggaggcagaagacttgagagcctcttggctcaactacctgtaagctgtttgaccttgtacaagtcatttaaactttctggcttcaacttccacatccataagtggaattaataatacctcatcaagtgatgagaatggaatagatattaaagcactgctcctcaaaatttaatgtgatacaagccaggtgtggtggctcacatctgtgatcccagctacttaggaggctgaggtgggaggatcatttgagctcaggagtttgtgaccagactcggcaaaatagcaagaccccatctcaaaaacaaataaagaaaaatgcatcgaaagtaaagaaaaaagaaaaaaataataattgaatacaaatgaccttaaaaaaagcagagtttaattcattggacctgcggtggtgcctgagagtctccatttccaataagctcccaagtggtactgctgctctgtggaccccactgtgtgtagcaaatatcagtggaaaacactgttattcttccaaatgatagtgaatttgtgtcctattgccatttttatttggtgcatgttttccctcagtatctacccaaccgtcaattactagatgcttgtctacggcaggtgatgtgcaggacatagatattttaaagtttacaaagacattgccctgtcctcaggaagctttcaatctatgtgagaatgaagatcacttaccactacaaacagtttggacatggaggaccaaagctacctaccccttatgctcacatagctggctgtcgacattaacatggtttacctttccattgtcttcattagcataactttcctattacagataactcttggccaggcaaataatttgactgttcactaaagtaacttccccaaactcccatcaactcttcaacaaaaaacatcaatagagttcacaccttaatagtctctgagcctcttggctagaaatcttcactgtgctgtttccaccaaactaagttgtaataccatgatccttacccaatcctaattgtgcccccacagtgaaagaccaatcttaaaccaagcttcatactcccaatgaaatccaacctcacctttctccttatgaaatactaccaaagctttgtccaggctgtggtctttcttaccatagtaagcaataaatttaactttgtcttatcaacaggttgtattggtgatgtttagggagctgaaatttcccatatggaagaaatagacatgggaatcaaacgtatgttacaaggagataagcagtggtgccaaggggtggattaaaagactctagctccttttttgtcataacaaataaacatccaatttaattataatcagtacattttttctctgcaaacttagtttaacaacaagtcccctattctcctcttatttactcacccaggcatttggatgttatcactggtgccatcattgattgtgataaaatatttgataagttttatgtcctcaatgcttcattaacagtataatacatgagagtgacattaaccaagattaagggagaaggggaaatcttttggtggttgtgatgtcaaacctaaaactacatggaggcccagaattagggaaaattcagcatccagacagacaatgtaagatcacggtattttcagggaaaaacatgaaccggagcaaaagctcaaaatggggaaagagcgagagagaaactaagggtctaaacagtcttttatgtcaagttaagtggcttatgtctttgctacccaaagtatggtctgcaggccaaaatcattgctataaccctgagcacttgctagaaatgcagaatctcagacaataccccagacctactgaatcagcatcagttaattaagaaaatccccaggtgattctgatgcacatcaaagtttgagaagcactattcaaaataatatgctggaggctacgggaagctactgaaggattttaagaagggaagtgacataattgaatttgcattttagaaaaaaaattactctgtgtccattcattccttcaggatatatatgccaagcattgaccttagagctggaaattcagcactattttgagtggattagctgaaactccctattcagtattcattcaatgaacatttattgcattccaactttggttttttttttttttgtttgcgtgtttgttttttgcttttttgaagacagggtctcactctgtcatgtgggctggagtgcagtggcatgatcccggctcactgcaacctctgcctcccgagttcaagtgattctcgtgcctcaggctcctgagtagctgggattacaagcatgcaccacaaaagccagctaatttttgtatttttagtagagatgggggttttaccacgttggccaggctggtctcgaactcctgacctcaggtgatccgcctgcctcagcatcccaaagtgctgagattacaggcatgaaccaccatgccccacctgcttgcaaactttcatttgacttttccaaaagcttgatttggaaataatcccacactgatggctatgtttttaatggagtcaacctttgttgtccaggacaaataactgttaagaatcttctagcatactgtactcaaagtccttagcactatcaggctgttggctcaaacatgaaaggtttttttgatgtagttttgtagaattgttattgcaatggtatttgctgtattggaatttgacccacagtacaagttatagtacaagataccaatcaatattgttttttgttaatgaacaacataagatgtacagcttgccaaatctaaactttaatattagagattataggatcagtaccattttttgctaacctatgcagaggattgtcctttggtgactgaaaaggaaaacaataaattcctacttatgtggagtctctgtctttttaataatagtcagtgtcttattggaactcacaaagacttggtgtgaagagctctgacaagctagttagcctattttatgcttgttttattcttgcttcctatatgcaaacatagtgaaggacagcgggcaatgagctcgcacttctattttagcgattctgggttactcgggctgcctctaatctaccaagccaggattattataaggaaaataaccaatgtagctaaagataaagtcatcacttccctaactcaattcctttgtagctgcaggaacactaaatttcattcagaattctaactcccaaaaagctgggtaatctaagacccttaatggttttcttatagcctcatagggtttggcaggtgccctggacatctggcagattccctgagagaacaaaaactcagaagctaccaaagattgaaatactcccttcaatacccaccaactaggggagcttatacaagaccgtgggtttctttctactttgttcttttatttacataatagcaatgataatatctttgttgtagaattactcggaggattaaatacaagaaaatatttacagtacctagcacttaataaactctcaatatatattaattttccccactcccttctgggttactaagacccctataaaatgcaaatttatttacatcacagtagtcactaatatttttgaaaagttgagttaattgaattaggaagcctgttataaagaataagccctgagtaaagaggatgtgtattatgttctctaaggtatgtgaagtgtgtgaaaagaaggtccaaaaaaggagggcttgcttgagatgactgatatccaagaagatagtacaccctagctgtcagaaccattgactttaagggctgaagatatcataaaactatccattttgcagatgaggacactgaggctaagttcggtgaaataacttgcctaggccttagagttagaacactagcaaggcaggattgaaacctagtgaatgagaggcttcaaaaagaaagaaaacaatgtggacacagggaaaaggtgagggagagcattaggacaaatacctaatgcatgtggggcttaaaacctagatgacgggttgatgggtgcagcaaaccaccgtggcaaatgtatacctatgtaacaaacctgtacattctgcacgtgtatcccagaacttaaagtataataataaaaaagaaagaaggaaaacaatgtgaagaatgaaagcaggatagggaaggagggagcgctacagctcagggtgaagtcttgtatcccctttgcctctgtccccttagtagtaaatatttctcggggtgaatcagtaacatccctcagcctctcatacagaagtgccagagtgtgatctggctattctgccattaaacattcaagatcctctacaaccatgaacatagaagaatgatttatccttatgttcttgctgtatcaaagactctcagagattttcagagacatgccttttccatactgatcaatgaagatgggtcaccagaaacatcgtagtcaaagtgacagtttttgtactgccttcccagataattttacagactgacatgaatttgaagcaacaagcttttttttttttttttttttttttttgaggcggagttttgctcttgttgcccaggctggaatgcaatggcacaatcttggctcaattctcctgcctcagcctcccaagtacctgggattacaggcatgtgccacaacgcccagctaactttttttttttttgtatttttagtagagatgggggttcaccaagttgatcaggctggtctcaaactcctgacctcaagtgttccacccacctcagactcccaaagtgctgggattacaggcatgcaacaagcatttttatgaagaccctgcctgaatagccattcattccaaggggacttgaatttgaataatacctccacacagatgactctcaaatctgcatctctagcacatacttcttccctgaatcccatactttcatccaactgcactctttgtgactttactgggatgtctaacaagatttcaaacctaacaattccaaaacaaaattattgcttccacctttacccctctaccatctaacttgatccttctaccattttctcaattctattcaccttatccaccttggactcatcctgggctcttctctttctttcccaccccataccccattcatcagcaaacctggtagtgctaccttccaaaaatacccagaatccatgtacctctcattgttttcactgaaagcttcctggtttagaatcaccattatttctcatttgaattattgcaatgactccctctgcttcaataggtactcttactctctgttctccactccgtggctagaacaattcatctcctttctttccccaaatgagtttacttagaaaactcccttgaaaagacaaaatcatagagatggagaacagattaggggttgctagtgattcaggaagtagaatgggagattggatgggtgtgacaattaaagggtggcttgagatagttcctttgtgacgctggaactattcagtaccatgtatcaaaataggggtagttgttatatgactctaaacatggtataaaattgcatagaatgacagacacagataagtgcatgtaaaagctggtgagatctgaataaggcatagattgtgttaatatcaatttcctggtttttatattgtgcatagctatgtaagatgtgagatctgaataaagcatagattgtatcaacatcaatttcctggtttcctggctttgatattacatataattatgtaagatgtaaccattagctgaagatgagtgaagggtactcatgatctttcttaatacttttgcaacttcctgtaagtgtatatgtatttcaaaataacaagtttgaaaaatactgcatatacacggcattcctcaagactacggattttctgtttcttctacctggaatgctctttccccaaatatgtaaatggataatttctccccttccttgagatttctgttcaaatgtcacctcatagaggtctgcccagagtgtcatacataaaatatcaattttggctcggcacaatggaccatgtctgtaatttcagcactttaggggtggaggcaagcagatcgcttgagcgcaggagttaagaccagtggtactgaggtagtgaggtactgctataaagatacttgaaaatgtggaagcaactttagaactgggtaataggcaggggttggaacagttaggaggctcagaagaagacaggaaaatgtggaaaagtttggaacttcctagagacttgttgaatggttttgaccaaaatgctgatagtgatacgaacactgaagtccaggcagaggtggtctcagatggagatgaagaacttattggtaactggagtaaaggtcattcttgctatgactaacaaagagactggcatcattttgaccctgacctagagatctgtggaactttgaacttgagagatgatttaaggtatctgacagaagaaatttctaagcagcaaagcattcaagaggtcacagagcataaaagtttgaaaaatttgcaacctgacaatgcagtagaaaagaaaaacccattttctggagaggctggctgtagaaatttgcatatttaacaaggagcccaatgttaataggcaagacaatggggaaaatgtctccagggcaagtcagagaccttcattgcggctcctcccatcacagacccagaggtctaggaggcaaaaatggtttcgtggaccaggtcccccccccaaccccaccactgtgtgcggcatcaggacttggtgccttgtgtcccagccactccagccatggataaaaggggccaaggtacagttcggaccattgcttcagagggagcaagtcccaagctttggcaactgccacgtggtgttgagtctgtggatacacagaattcaagaattgaagtttgggaacctctgcctagatttcagaggatgtatggaaactcctggatgtccaggcagaagtctgctgcaggaatgaagacctcatggagaacctcggctaggacagtgtggaagggaaatgtggggttggagccccaacacagagtccccactggggcactgcctagcggagctatgagaagagggccactgtccaccagaccccacaatggtagagcgatcaacagcttgcaccacgtgcctggaaaagctgcagacactcaatgccagcctgtaaaagcagccaggagaggggctctaccctgcaaacccacaggggtggagcttaccaagaccatgggaacccacctcttgcatcagtgttacctggatgtgagaaatggagtcaaaggagacaacttcagagctgtaagatttgactgccctgatagattttggactggcttggggcctgtagccccttcattttggctaatttctcccatttgtaatgggtatatttacccagtgcctgtgcttccattttatctaggaagtaactaacttgcttttgattttacaggctcacaggcagaacagacttgccttgtctcagatgagactttggacttggacttttgggttaatgctgaaatgaattaatactttggagtactgttgtcaaggcatgattggttttgaaatgtgaaagggacatgagatttgggaggggccaggagcaaaatgatatgtttgggctttgtgtccccacccaaatctcatcttgaattgtaatccttataatccccataatccccaggtgtcaaaggagaggctatgtggaggtaattgaatcatggggttggcttcccccatgctgttctcatgatagtgagtgaattctcccaaaatctgatggttttataagggtctcttccccctttcctcagtacttctccttcctgccaccttgtgaagaaggtgcctcgcttccccttcattttctgccatgattttaagtttcctgaggcctccccagccatattgaactgtgagtcaattaaacctctttcctttataaattacccaatctcgggcagttctttctagcggtatgaaaacgggctaatacactccctctcttgagatttctgttcaaatatcacatcaaagaggtctgcccagactgccatatataaaacatcaatttcggctgggcatggtggttcatgcctgtaattccagcaccttaggaggtagatgtgggtggactgcttgagccccggagttcaagaacagcctgggcaacacagtgagactctgtctctataagaaaagaaaacgtgttagctgggtatcgtggtacatgcctgtagacctggctacttgggaggctgatgtgggaggatcatctgagcccagggaggtcaaggctgcagtgagccatgatcacgtcactgcacaccagcttaggcaacagaatgagaccctgtctcaaaaaatatatataaataaaaaataaaacatcatgttcctgtcactttttccctatcttgttagtttctcttttcttcttaacactttaatacttccatttgaaataccacatatttattttctcctttcctaacttcccattactatatgagctccttgaaaggacagcgtttgtctgtttttggttatccttgtgcctatattagtatgtggcacacaatagtcactctacaaatatttgatgaattaataaatgagtgaacaggtaaagctagtagaaggaacagtcatgcagattggcttaataggaaatacaagtctgacaaaatcacattccttggcagtacttaaaaaaactgggaaggaaaaagaaaacttgctcctgctgcttctgtgatacaaagaaaaacctcattattagcagtttttttaaataataaagttgagcattaccatgtagaatggtattatggacagaacacaccacatatgtataaaaataagtaacttccctgggaagaatcaatacagatagtccctagattacaaatgagttgtgttctgcacatttgaaagacagctgcttaatgatctgctcgatgctctctaaattttctgaccgggttcacttcacccctacctgtgcattcagtcatactctattccctggaatcaccaaacctgtacctaacagaggaattcaatgtggttacatttcataggttagtccacaaaataatagttcacttataaacgagctgaagtatagtgtaaataatgctggttttaactctgcacgttgtaagtaattcaaatgcttagagttgtatcacatttaatggtatatttacctgagaaaggcaatattaaacgtgcaaggaaatgtgggccttgaagtcaagtacactttgaaatcaaactgtcactctgatgctacctttgtgatgttggtccagtttcttaacttcttgaagccttaatttcctcaactgtgacttggagatgatcattgagactacccaccaggattgttttaggattaaaggagataagtcttcagcacagacttagtgttccataacattacatcttattatattgagcacttccagttagtctgagttacaaatgatattttacacatcatcgtaaaccaacggtctaacaacgtccctgatacacggttaatgctaaatatgtgaggtgaatgaatatttaacaagtacattgattcacatactggagagggatgaataggcatgaaggacaggcacgaaggcctttaatgtttgtgagcctatccatctatgatgttttccttttaccttcctcccattaccttctaattctctactcacaggtttgctaaaagatctctcttccaccaccactccttgtccccacagtgggaggagcatgagggaaattcaaaaataaataccacttatgtagcattttttggttggaattttagggtcaatatttagttttaaaatgtgttaaatgtacattttcattaaaaagaaaagaaaacatgatttatacaagataagcatgacttcttcactgctgcatctttttgaccttagtttatagaatctcaactgcagcctggggcctgccccatctctgaagaccgtgctgcccaaaggatgaggatatgaagtaccctgttaaagtaattcattggcatgactgcttggtttgtcctggattaatcatctctctcaaggagattttagcccatcggcccattcctgtgcaagatgcctaacctgattcctaggctcccaagctagaatgaagatactagctacaagtcctccccaatgctagactaacatacaattttgatctctggaattctagtcaatgatcctaccaatgtgagctctacctcttcatggcccctaaacgctgatatctgctttcagccttaccatataatgctcttatgctcttcctcttgaaacacatgttaagaatgacccatcttccctttggaagagtttaagcagttttcataatctctttaaaaaaatttgactggcatcaaatcaagctctgaccaatgacagttataaaaaaaaaaaaaaaaaaaccaacaaaaaaactaaattccctcagagaaaacaggaaagtatgggagcaactttaagaaaacacttggaataataacaaactgttacttaatatttaacctatcttttccccgaagggctcaagctgattattttcttgcttttgacggctagtgaaaataattggttcctctcttctttgtcacctccttgaactattaagttttcccttgatgttttctcatgcatgaatatgccagtaccacttacacaggtcttgtaaacaagtttcaaaagctattagacccacataaattacacaaaatatgtttcagtccctaccaaatttcctaaagccatagttcgtctgtccacatcaacccactcccttcttttattatccctgctttagctaccttgtcactcaaataaactgtgtaattcacacctgctttgagctgattggttgatctgtccttgattgtcccaggtggatttattctcccttaagcttcaggtaggaatcctgcaggttcatacctggagaaggagataaacctatgccttaaatgcaatgttcattaatggataaattcataactggcaatggtaccaagagttacagcatcttcctctattaaaagcagagcagcctatgggatggccaagtccttgaaggtgacagggatttgacaaaaatggagggtatgaatgggctatattatagttaatgatttgaaatcattgtttagaaataattgcctagacaagataagttaactgatctctacaaacttgcattatatatatttctcatcactatgcataatttttattatagatttgtcccttgaggtccagaagcacaaagcattctcatagtcccccaacaggcatctttctttaagagacaaagcaaggcaataaaaggggggtattttatttatcgcccaattcacagcatttctgtcttgactctgagaagtgtaaattcataacaggaggtttctagacatacatatagaaggtgatgctggtgatccaaaaaatattgacaattgataaagaaatgctgaaggaggtgtcactattactagaagtaaaagttttaacaataacaataaatgaggcctctttctgtgtccatctgtccacaatcccatgccatctaccccttctctagagttgccatggaagagaaagttccactacttcagttacgtcatttctatttggaggaaagatgggggtcattttttctaattgaagagtgttgtgacatttttttcctcgcattgtttcatttcatttcgacttatcttttttcccacttataatgtgcatattattttttgacatcaagataatgacaataaagaaaaaaaactcactgtcttctcaattttaaaagaaaaaatagcaaggaaaaatgatcagctaaaggatttaattttaatgttgtgataagctatttttctaaatgattttccacataatctgtgctttagcaaagatcttctcttttttttctagtttccatctgagattagataatgggctgtatcccattatgtgcatgctgtaactccaccacacctgttacttttgacatatttttatatttctcaataattaaaaaagaaagagtgggccaggtgtggtggctcatgcctgtaatcccagcactttgggaggctgaggtggatggatcatctgaggtcaggagttcgagaccagcctgaccaacatggtgaaaccccgtttctaccaaaaatacaaaaaattaactgggaggggtggtgcacacctgtaatcccagctattcaggaggctgaggcaggagaatcgcttgaatctgggaggcagaggttgaagtgagtcgagattgtaccattgtactccaacccgggcaacagagcgaaactccatctcaaataataataataataattattattattattactataagaataaatggtagcttatttttacctaaacgtagtagtggcttcatgccacagttgctaatctctgagccatctcactatcctttgttcagcttgttaaatgtctctatactttcgtaactagttcctcatagtaaattccttcttccagaccagtgtttcccaacctcaccacaactgacattttggacagaataattctttgttgtaagagactttcctgtgtcctgtacagtgtctaccaatatctctgtctctaccaaatgaataccagtaacactcctgcaattgtcacaaccaaaaatgtctccagaaattgccaatttatccctcagcgtgcagcagaatcacccctggctgagaaccactgtattagactagaagatctttacttttctgactgactcctaagtgatatactcctttcaagcgcatatttatacctgttatatgtaaaaataagattggaataaaataacatctatctatctgtgtccctataaaattagtcatactgtggtgatatctacatctctataaaactagtaatattggtaaacaataaaagcttattcagcaaatgaatatattgatatgaaaagatctgcaaaaccttgatctactttttccaaaattaatacatattttattttgtccagctaatatttaatatatttttatttaattagccatcatagggcctttgaaatagttcatacattatgatgccttatatactaaagtgagtaaaattaaacatctgttaatacggctgacacagaaaaacacagtcagataggcagttttagagaggagaaatatacaataatagttcttctttttcccacctcacattatgaacagggaagtttttccttagcactaacatctcagcaatacgtaaagatatcacatcccttattttgtatttattaatccttcttttaatgcttctgttgctaattttttaattgactttgtccttaccgaatactagtgataggatttataaaggatgattaagtcatggactaatttaaactttgttgaactcatataacagtgagtttcaatgaaatcacactaagaattctctgtaatgctttgttccagctataagaaaacaatacccaatttcatctaagagatgaaaaataaagaaagtatgtgaagataatcatattcaatagttattatattatgataatttgcatatgtagacatccttgaaatgtacatagacctttattcaagatctttcccatacatttcagaattcgtttttatcattcatacatttgataaacatattttaagtgtaatatttatcttatcaacatgtaatgcatacttaacaatgtgtaatattgatcttatcaatgctactctaccaaaattaaaagtagatcattaaagaaaaaaatcaaattcctcttaatgtcatagaaaaacattcttctctattaagataaaggacaacttaataaatctaatattttcatagctcatataaagaaatatagataggattagacaaatagaaggaacaaatgaaagcccagtagattaccagtgttttgagccttaatttaggaagttatcaaatatgtacttattcatttcagggaattgtatggtttcagaaataagaaaagcgacaacaaaacggtcaaatttgcctgaatgattggtcagctttgttcattctaaacttaataatcctttactaattcagcaaagtcttataaaaaatttatcaggtcattgttcataatgatatgagcaaaaaggaaatggaaatagataacaggtcatatgatggatttcattcaaatgttataaggcattttgtgttaaatatttgtcattcatattacatagaaatataatttatgtagaggaatgtaataaacattactctttttaaaaacatcagtttccgaatatgccacagaatcttaatttgattgaaatgccctccctctcccttctctcaacagtgagtcttattttgtgttcaatagcaactaaatgtttccagactgtgaagcctttctcaagtcccacaacgggagttatatctgtcacctatgatcccacagcaccctcttcatcctctattataaaatactaccattttagacttatactctatagtgttctgattttgcccatatgcctaactcacacatgagatcactaaggccagaaaccatatgttattcaattttctgtttatgtggccagttccttacaaccttgcttatataaagaggacattcacaacatgtttataaaattgaattcagctgaaaatttttaatgagtttgcactgagaaatgagataaaacttgaaggtatttgcatgataactgaaaagctgtggatcaaatcaaagatcatagaggtatcttggaatacaccacagtttggaggtatcagaatgatctggctaagtatttgttgcagtataggattttgttttaaggacattaactgctcaattaaaaaaaaattggactcaattttattttcagcttgtgatacctgattttggtgtgtgtgtgtgtgtgtgtgtgtgtgtgtgtgtgtgtgtatgtgtgtacttttacattttcagcagcatgtggcaggtggctttttagggtacactattcctgtgacctgttgacgtgacaaagaggtcgttggagaaaaaaatcactcctcatgagtacagtagtatcccaagagaggcagatcacactcacacatgacataagaatcaagttttactgaaaaatcatagaggtgtttttagtaaagcaattaagaaaataatctttttcttatatatttctgatgcttcctaaaaattattattatgattatgattattattgagacggagtctagctctgtcaccaggctggagtgcagtggcgcgatctcggctcactgcaacctccgcctcccaggttcaagtgattctcctgcctcagcctcccgagtagctgggattacaggcatgcgctgccatgcacggctaatttttgtatttttagtagagacggagtttcaccgtgttagccaggatggtctcgatttcctgacctcatgatctgcccacctcggcctcccaaagtgctgggattacaggtgtgagccaccgcaaccagcctcctaaaaattatcttataaataagactaatcaattaaaatattttaaagatatttttcttctaactatacttccaaatatttatatgtatgctttaggaaattgagtttttaagtgaaatattaaagacatctcattttcctgttacctgattactgttcattcaacctgttgctgtattgttccatttttatatgatataccataagaggctatgtgtgaataaggcaatatacatgatgcagcattactttgtattcacattttcaaggtgtatagaaaatttttaaaaagatgttaaaaaggtaaataagttcattgttaattgttatagaaagagtagacaagagagaagactgagtctacatttcggcaaaaagtcttcataaaaattagaaaattggtgagtaagtcaatgaagcattgtcaaagtcacaaacaaaaggtgactccacattattataattcccctgtcagaaagtagacatggcaaacttatgacttcaacctctgaaaatgaggatcacagaggagaaataagactggacaacaggcttccagctgtgtttctaacaagtataattacactggttggacattatcattaactacatttctaattcttctcataattcaaaaagtgagagagaaaaaggaagggataactctttttggtgttatagtacctcattgtaggtttccaaaaacaagtgactcctgacaacaactgttagctctgaagtgagagtctgcaaactgcagccctcaagccgtaactagcccattgccatttttgtaaataaagttttattggatcacaatgacacatcttcatttctctattgtctatgactgcttcaacattctaacagcagagttgaatagttgcaacagagtatagaaaacaaagcctaaaatatttactctctggccctttacgtttacattacagaaaacacttgctaacccctactataaaacaatgttgtctttggaagctatggtaaattaaaaacagaataaaactattgctcacgtatattttattttcaaagtaaaattacttttttccccttctatagatattttttttttttcctggaaggagcttccaatttcaagcaagaacagaagcagaagcactccaataagtgtgcttggttacatgaataacttgtgatggtttggatatacttcctggcaacacgcaatgttagaaacctagaaatatgtctgcctggtacttttaaggggaatatatagagagcctcttttgaaactttgaaaagatttattttctattctggagacattttagtatggagagttgaaggttgcataaaaatacagcaactaagatagttggaatagttattctctagggaaacatttggccctaagacaagacatgttggaaacacataaacaagcaaataaaattggcaaatgtaagttttgattcatatatgctcgtgaaactatattcttaatgctattgagaggtgaggccagctggactttctgggtcgagtggggacttggggaacttttctgtcttacaagaggattgtaaaacgcaccaatcaggaaccttcccgtcttacaagaggattgtaaaacgcaccaatcagcgctctgtaaaatgcaccaatcagtaggattctaaaagtagccaatcgtggggaggattgaaaaaagggcactctgataggacagaaatggaacatgggaggggacagtaagggaataaaagctggccacccaagccagcagcggcaacctgcttgggtccccttccacgttgtggaagctttgttcttttgctcttcacaataaatcttgctgctgctcgctgtttgggttcgtgccacctttaagagctgtaacagtcaccgcagaggtccgtggcttcgttcttgaagtcagcgagaccacgaacccaccggcgggaaccaactctggacacactatgaccttaagtaagtctgtcttcatggatcctagatatttcctagcctttgtatcttccttaaaggttaccttcaggtgcttttgaagttgttatgaccacatgtacagtccttaccttttgtacatgaaactcaacttttgattcctattttatgtttccattagatggctacgtatgtaaacaaaaaaagtttttgtgacactcaggcattactacggagggaggtgaacgttcattaagacatttatctcaaatattgcatccagaagaatgacactaagaataaactcaattgaagtatgagataatgtgcttcaaagactaagggactaaataactcatcctcttcctaattaccttatagataccttagttctctttatccttctccaacatacaaagctagttcatttttaaggtctttgcataagctgtcccttgtgcccggaatgctttgcccctacatcattacatggctgactctagtttgtccatcagttcttcttcaaaatcaccttccaagtgaggtattgaagactttttcaagatttttctcttttttattaattctgtgcataatatttcccactttctaaattgttttcctttctcagtttgtatcctatccctgcttactaaaattacagtttcatgagcacacgggacctatgcttccttgtacgtagtgtgcaggatattacttggaatatagtgggcacccaatatattaatgaatacaatcattgtagaaagttaaatccacagtggtccagatgtggtgttaagcatgaacctaaatcttctaccttcaaggtgctcctaatatggttgggttgatgatcacatacaaatcagataattataccacttgaggaacattaggtttacaaactaagcattattatatcattttattaaaatgtattcatatcagtaaagtggggacggtggagtcaaggaagaagtattgtaggtgacattttagctgagtatagaaagggaggttagggatgaagcaccaggcaaatgcttgtcacaagtgaccttgtgagtcacttgtgacatgaagtgagtcacttgtgacatgaagctgtataacgtgcttagaggaagacatacagttcatcacggtcacctttcgtcctgacatccacattcatttctctgactacccaacccctcacttggatttttcaaaggtatctcaaaattaacacatccaaaatacgtttactctctttctctgcaactcttttcctctccccttatgcatttaaccattcattattttatccaatacgtacttactgatcacttattattttcccatttcaaaagaaatggcagtgttatctccagaggtgtatgacatcagaaactgggaatgatatatgacactttcctcaaattcaactctgcaatcgttcaacttaacactaacccccgtcaattacgtctcctgtatttttctcaggtttgttgtcacattctcactagaactattttagtcaagaccaccatcgcttcttgccaagattacaataataacctcttttgtccattcagatttgcttctctctgaaccattctccacacttcagcgaaagaagtctctgaatcaaagctctaatcatgactctttcctgacaaccacgtgacaaagcccttctgggcagagaaaaaactcccaacaggacccgaaggaccctccaggttctagccccatctcctctttagcttggtctcttgaacatctttcttccaaacataatctgctgtcacattctttctgttcctttatctctgacactctcaggcttagctctttaaatgtggtactctgcatagaaaaatttccaccaccttcacggtagttttgtgtggccaagtctatatcacttcttcacagaagcttttggtgacccagatactaattcaaatttctaactcggacaccagtggttcccctttctctctctctctcaatctctctctctctctctcagaatctcatgagattcatcatggttgattacttgcataaagtctgacatccctgctgggattatgtctgtcatgttcacttctgtatgctcagcatctagttataattaataataataatactaattactgagggagctaaatacttatttgttggatgagtgattgtggtaaaaatgaaaatgaaatgatgtaaaatagtggaatgataaaacagagtgttgaaaatgttgatgagagccagattataaatgctttgagaaatatttcagaggctgtgctgacaggattttggtagagatttgggcaataaagagccagaatggatagggatatatgataactgcagggtttttcagagaaagtgaattataaatccatcagtcaatataagaaatgcagaaagaaaaacaatgttgcggatgttagaaaggattgagagattctgaagtgatgggatgttcaggaaatcgaagttaagatatctagtaggcaagcagaaacctaccttatggccagaacattctctgacccaaaagtctcaagaccattttttttttttttacaactaatgtcaataaactacttttcatgtacactagaaatgatagtgtgaaatatattaatgaggttaactattgttaaaaatcagaatatgcattcctaatatgtgtttgtaaaataaattttattgtatatatttaagggataccacataatggtgtaagatgcatagatatttatatatatagtgtaaaatagttaccattgtggagaacattatcatatctatcatttcacagttacccatttttcactctgtggcaagaacagctataatctattcatttatcaaaaatcttgaatacacactattattaactgtagtcctcatgatgtatattatatcttttaatatattaatatattttaatcatttgtatcctatgacctacattgccccatttcctcacaactaccctgaccctggtaaccactgtttaattcactatctgtatatatttgaccttttttaaaaaaagattccatatataagtgagatcatacaatatttttctttcttggtctggcttatttcatttagcataaggtcctccaggtccatccatgttgggacaaatgacagatcttcttctttttaaggctgaaaaatattccagggggtgtgtgtgtgtgtgtgtgtgtgtgtgtgtgtgtacacacgattcttggaccatatttctttgtaaactgttttctacatattcttagcccttccatagaaaccccagattctctctctctctctctctctctctctctctctctctctctccctctcctcctgctcctcctcctcctgcctacatctctctctcccttcctcttaaagtaactctaaaatataattttaaatattcttattttgtctggtgccagactgttttggacactagccataaaatatttttagctgtgttcatttaagctaccatacaagccaggcgctacatctacagaacacctttctttttactttgtaagttcttttataatattggatgtggtgatgagataaagaaaagagtgaggtataatggtcttcctaggtatcagaattttctttttgagaaactgtttttcttcctttagtaacgaaaacaagagccaacataatgatctgagttctgataatgagtgtgttttggcacaaactgtcacatgaatcaaaggtaacttgaacatgtataaattaacattccacagccagaaaatatttagattcactaaatctgttactctaagcaaaattcaggagttaagtcaatgatagatggccattttggtgtctggatcttaggagaaaataggaccataagaaataaacactgtccttacaaagaaataaacttttgtcctggagttaaatggtaaaaaggacgccccctcaggggagcataccttgataatattgatcatccaaataggatgatatggtttggctgtgtccccatccaaatctcatcttgaattgtagctcccataatccccatgtgtcatgggagtgacctggtgggaggtaattgaatcacggggatggttctgtgctgagggagctaaatacttgtgctgtccttatggcagtgaataagtctcaggagatctgatggttttataaagggcaattttcctgcacacgctcttgcctgccaccatgtaagccatgcctttgctaccccttcaccttccaccatgattgtgaggcctccctagtcatgtgagactgtgagtccattaagcctctttttacttataaattacccagtcttgggtatttcttcatagcagtaggaaaatgaactaatacataggattattgagaaatatacatcaaatataaaatgtgatttttaatgattttttctcgattgatgtctgatggagactaagtgcttaatatgaaaacagaactcatggtgttttcttctgcggaaagcaagttagtgtagtccaggcttgtaacttgctggtataagaaaagatcctagactttccaaagggaaaaatggacagaaggttacatcgtagggtcagcagtttcttagatgtggtcatctggttatagtattactctgaaatattacctccttctaggtttttgataggagtgggattgcagacaatttgaagctctactttatgatgaaagcctggtgagctctaattgagaaatacagacctggtttggatactaaatgagtaggtgtttattaacacactgttaggaaaattgagaattctggcaggttttagtgctcaaagtaaaacctttcccatttacagagagaggtgggcttggagagacccttcagaatgagttgggaccttcctgaagaaggagctctggatccgttcaagcatcactgtgacttctgagagacacgtctctattagtccattttcatactgctataaagaactgcctgagactgggtaatttataaaagaaagaggtttaattgacacacagttcagcatggctggggaggcctcaggaaacttaccatcgtggcataaggtgagaaggagcaagccaccttcttcacaggtggcaggaagaagtgcccagtgaagcaggaagagccccttataaaacaatcagatcttgtgagaactcactcactatcaggagaacagcatgggagaaattgctcccatgattcagttacctccacctggtctctctcccttgacatgtggggattgtggggattacaattcaaaatgagatttgggtggggacacaaagccaaaccataggatccatcaaatcccaggatgatggttctccatccccacaatgtgtgcaatattttaggagtcttttgttactcataatagctaaagtacagatctttgcaagtagtttcatcttccacgagtgaaagcagattcaaacaaaaacattactctcacctgcatcatacgttttcgagagtgagcagtgtgctggaaattgccccaacccatgctgttttatgtaagccatagtccttagaatgtaggtactcagagaagagcaggtacttttttgtgctaggaagaaacatggccaagcaatactgctatctgacgaggaagctgttgttctttaacctggaccattttcagagtaggcattttaaaagctgcctgatgagaactttttgaaactgtagcagagcttccatggatattctgattggatatatcattgcttcctgctcagcttgctaagataacttgaaaacagaaaatccttttgtctggagtaggtatttaattaaccaaatgttaagtattgtgtattttttcagttgcttaagtggaaagacattattacctgaatatagtttttttatgaacaacccagaatattaccgggttaaaggtcattggtttattacttaacctaaaaataattgctttgacatatatggaatattgtatatctcattattttttgataacttcagaagagctaatataatcggaggcagatctacagtggaatagggaattcagaatttatattctaacagaaaaggatacagtaatatgacaaggaaattcctaaaaatatagtatattttccatgtgaaaacatatttccagaccaatttcaaaagaatgatagcttagattcctctctgctgcagtaagctatatcccccacttgaaatacatcccacctttcctataattacctcttccaccagaattgcaattatacatttcttttaatcttttacttttcaaaaataatggaaatttaaattgggaattaagttgcatttaatttccagtttcgcattttaatctttgaaaatagcctagccacaggcaaggtgcagctgaaagcttcaatgacagcacacctaaaatgggaggcctgtcagatttgacatatgaagtggtggtttggcttccagcaaagctttgtccattatgctccctctcttgttcacctctccctctagcttttcttccactgtcagagagctgaaatgcgaataattctactccaggaaacatatttcacataatttctataacaccaaatgaaaagcctttagactatattatcatagaagctagtccttatttaacaccagattttattggatatgtaattttatatacatattgtattacatacctctacctaaatacagaaatactttacagccttattatgtgtaataaaaaaatctaacatcttctcaagccacattgcagatggtagtattatctggatggtgcctcatgaacaaacttcaaaaggaaatgttgatgtgagaagattcctatggttctggtaagactctacatccccctccccccaggtctgtggaataatgtataggcatataaacagtacatacatggcatcaattgttataaccatatatatgtgtgtgcgtgtttaaattgtattaataagatttttttatacactcagcacctaacagtgtctaacacattttatatcttccaataaatgaatgaagcaaatgaaaacatcagtaaacagaaaaaaacaggcattttattcagtttactttaatttgagtggtgtttggttgtaatatctgacaaaagttagtgctatttaatggtttaaaataatttaatgtgtagttttcccctttaagttttgccctgtatcttttgctatggtctgtcagctataatttgttcaatcttttgtgtagctttcttcccagtcttacaagtctaattggggaaagtaagggaattaacaatgatcaaaagtctattctttttctaaacattcacatatctttgaatctctacaggaatcctggaaaagaggatcattttgcagaaaaaaaacataggctagagtttctgaacaccttgtcccaaaggtacagccagagtttgaatccaagtcagtctaattccaaacatagatcttttcctcaaaccataacattttcaagaactgtattttatcatttcttatgatccctgccaacttactcacaatattatcagtagcctagacattcactaaatgccaactgtgaacaagtgaagcctttaagacttggatggtgttgaagttccctggtgtgatatttcagtttactcagtacccacctgaatgaatgctttgaagaaaataaacaagtgaagcttaatcagctaagtaaatgtttggataaaaaaatgaagcttgtttaaataagggaaagcccttattcttctctgatctactcatttaagtcaaacaattaccataaagctaattctcaaaattatgttttctttaattattgaattgggttagtactgtcctttgacccattagtccaaatacacacatgcacagctacacaaatatatatatatatataaatatatatatatatatatgtatgtatacatagagagaatctaaaaaatactctaactgacaagatggagatgacactaatttatgcatatatcagggcaatttcaatttctgcattttaatagcttatctctgatatttgcaaactaagagcttcatttacagactgtacttgtatcatgagttcccaaactacaactacaaatgtttaaatatctttttaaactgagtgtgcatgaatgttttttatcagaagcattatttaaaataattactattatcttttaagtagcatcaggctgttggaatttgctaggaactaccaacaaataccttctcttaaagatactgatcagggaactccaaacattcttgcttctgtatcccctaaaaagactcttgaaaaatgagtcaacccttgcagatttaaaatccgcattcgaaatgtacttttcattcttaaatgactgaaaataatataatttgagggacattgtaaatatcgatatcttaaaactaagatatatgtttatgcctgaaaaaatcttattgatcacctagtatacttttcttaaacagtatgtatacacaatgagtgttttttttctgttactgtaagtcctaaatgtaaaaaacaaaccttttcaattgaggtattgttacaattattaacgtgcaattgaccaaaacaatatatgtatattataaaatttgataaacataaaaataaaattttattgaaaatacatctcttaataagatggatgggtatttaacaatttatacaccttcagaagaatataaattaattctacaattggaaaggcttcagcatcaattctatccctaatttttgtctgtatagatgtaaatgatgaaaaatcttattcaaataggtgagtagaaagaaacggaaggaattgtattatagtagcattgcttaatcatttgtgctcctgctatggcatatgctaaaagtacatgatgattgcttaccaaaacgtatttttaatgatctatcggctgacaacttatcaggtcttctcttcgggttcagttgaaagcaaagagttagcaaccactcttcttgcaaaaagctatgttgccctgtcatgaaagtcattcatgcttcttttgtttgaagccttagtaagatcagagttggatgaaatataaggctttttttcttaaattgggagaagtggttagaaaaggcaagtggttagaaaggagaaacagcctgaggtcttgactacagatgtcttttttttttttttttttttttcaggcaattcagttttcaggaagagtacaaaataaagtagaagatctagaaataaattcccttaaaactatctgtgcctactccttggaatgccttcatgtactcccaggttactccactgtgaggacagctgttttaagaaatttcgaatcattacctgtgacaagaaatataaactggcacatcagaatctcctgataacttgtgtgtccacttcctcagttgtacctcacagctaaatagttatctgttaaaccaagagaagttgcagttctgggggcaatagccttattggtatttgtgcctgaatataattctgaactccctcttttctaccttctaggctttgagttcatttatttcagcagcaaaagatgtcaggagcaagaggcagtcccacatagtgtagattcattgaatgagggagccaaacagtgatttagaaacaacattgccagtaactatctgattagccttaggcaagtttctcaaccttcctgaatctgtttcttcacaataactcccagtctggctgcaccttcgactcacacaaagatctttaaagagatactgttgtccaagcatcgcccccaggaatatggatttgattctctgcttaattctaaagtgaaggcaaaacaggaaaagtcaaagttagaatcattatccatatagtctttcaaaaaatatataataagtgcctatcatgagcagtgttgcaagttttctgtgttaaaatatctacaaattatacttctaaagaaaaattgaatgctacttgaatacaataaatgatacatttgagcttatcagtcttgaaaatcctttgttcaaaaacgatgcaaagtagagagggcaatttagtctacaaaaacttttatttaaaaaaactgaataaatagcacagacacatccaaaaagtgtatagcatggaaaaattcaataatgtatagcacagagacacccccaaatttgtgttgtttatcatgttgcatcatggtcttaattccacatttcatgtagcagaatgtatcccttcattttgagatccagaaggacaaaagggttgcacagttcccctttttctgcctctcggagatcttaaaaatgaatgataaacaattaattctacccaggataccaatgaaaatctattttcttttctttttcccaaacaaaaacctcagaaggcaagtaaactgaccttttaaatgaacaagatctgacatgattgagctaacccaagaaagaaaattcccctctgaagtgaataattttttaattaaaaggtgaaatctgacacatcacactggttttgttattattgttgttttcttccattaatctcacactcgtaagaaaaaaaatgagtgtattatatatgactgtgttttatagatgcatatattctactctatccatttcagtccatcttttcttaatgcatttgtcctgtcacttttactcactgtaattcaattttgttaggaaatgtaactcgctgttttatgctttatatatttcacctgatgcaaaatggactacctgattgattctgcatttttagtccacctttgaatttatagataaagatcaacaattaactttaagcattatgctaaaaaaatcttagccagaaggattgcttcctgaaaatgatttaatttgtatttttcttaaatataataaaatgccctgataagaagtaatcaacaattttgattctagttttccatttgatttgaacatgtacattatttcagcatggtggatgatacatatctacagcttgaaatatgtgcattggggaggttttgttgaatgctagattgctgttttgctgtagtttgatttatttgtgtgagttattagcttgatattggaaagtaactaaaatttgaatatatgatatctctgcttctgaaataaatatagcgattgaaaatggaccttttatgaacgttgagtggggcaatttctggcaggtggggaagagagtaaagaagattcattgtatgaaagcaaagcaaatacacatagaacttgtaatttaacggaacatatcagcagatgtggttctcagaatgactcttacatttacattaatgactatctaaaaagaattagacagcaccgtgaacttcctttttcaaaattaaaagttttttttaaaataaagaagttcagattttagcatcaactgaccaaagcataaggggccatccaagaaaaaaaataatctgaagcactttcataaaacgatgttacaaatcaatattttagacactttgaagatcatctccttgcttttcaaccttcacacttccgagacaggggatatatatgtttatatcatctctttttctaaaataaatcatttctgattgagcatcttttacagaagagcccactgcaaatgtcaatttttataattgcccagaccatacttgtgggaaaaatgaagggacaagagtaggaaggtcattcagggtcactgaatacatttctaccacaggaaagcattacgtcttttgcactttatttcttcaagccattcccttccaacatctcatatccctgtccccccagaaagttggagtcacaggtgacacagctgggaaaactttctttatgaaaagattaacacatgttttaaaaagagatacatatgtatgtcaaaattattccagaacactgttctcagaagggcagtaactgcaaccaagttagtttctgctattgaaacaaaatgtgaagctcatggggaaatttcatcacaatatgctgtctatgaattaaaaatccatttaatataaagcctccaagaaacaaagaaaacttgttttttatttttacagaagacaacgtacaactttttaacccctaacctaattttttaaaccaaaaccagaattattttttttttctttttagctttcaatgaagcacaatcaaattcctggagaaaagatgggaaaacggcataaaacaaagcacgaacacggtatttaaatccaagtttgccacaaaatgtaaatgtatttcagtaaatgttctataggatttgtaaacaattgaaaagctgttatttcttttacaactgcaacataataaacattataataatatacctttctggtaatgatatagaattttttatctggtgacaaatagttctgccaaaagacagataaagtaaatcaaatgcaggcgtaacatctatattatgtagatgtgtgtagttattactagtggagattaatatgatttattatgcttataggtcatttgtttgacctttatagtaaaatgccatttcatatccttcttacatattgttattattaacctccattagtcatatatttttgtaaataccttctctaaatccattatatattttaaaacttggtttatgatttattttgctctatggaagctttaaactatcagttaattcagtctgccaattttatgttttaagtcttccaggcttcctgacttaccaaaaatctgtctcccatgaagcttataaagtcctacactttcctttattgtttatatgaatttatatttctagttagctccttaatctagtagggcgtttttttggtctatagttaaacttataggtacatgaatagtcaattacgagacactatttattaagtgaaataggctatccacacagaactaaaatatccaatcttatttggatgttttcctggactctcacttgtaaaccactaacccatttctctagccttatgccagcacactgtggttttgatcacaattacttcaaagtatagtagaaatctggaagtgtatgttgctgccataatatgcttattaataaaattgtttccaatttatacacacacatacacgcacacaatttccttctatataaactttaaattacatcattgcctatttcctttgaaattatattgcccccaaacacatcaaaagcattctgattataactgtattaaattcaaatgttaacttggctggtattgcaagtttaatgacaataaatcttaaatcctaaaacaatcctacgtagtcaatttttgctttttcttatgtatatttttatgcttttcacctatagggtctacaatttttattcctccttaatttatacattgtcatcagtgtgaatgaaatatttccatttgcatttatagtcattaatatgaataaaagctattatgtatctattcataaagtatttttaaaattatttcacagattttaaaattgagtctcctaggttttctctgcacaataatcctatttaacaataatttttcttctttaaaaatatttcttctttccttttgaggttatcattactattattattttagaggtggaggtcttgctacttttgacttatttcatgagctagaccaagcaaagcaaatttgaaaactttgaaaaataaaaatttgataatttttaacgttgacaatggtgcttctttactagggtgtcagcaaactacaaaaaaaaaaaaaacaactttgttttgcaaactttgtatttataaaattttattgaaagcacaggcacacctactaatttaagtattgtccatagctgcttccaatgccacaactgcagaatcaagtaaatgtgacagagactatttgggccacaaaacttaaaatatttactatctgccccattacagaagaaaaaatgcagatttctctttatccttctccttccttttactacgcagcaggcatacttctaggatttttttttttttcctatataaccacatattatttccgcaaagttattaggaagtacatgggactttccagccccatttcacattggataaaactgaggcatgaataagctaagtcacctgccaaaggtcacgtgggtggcaaatatcttcagcaaaattttgaccccaaaagcctaactatgagttcataactgtgcagtagaaccctttcatctttggtcccatagcacttatcatactgtattgttttgttacattttttttattatactttaagttctagggtacatgtgcacaacatgcaggcttgttacatatgtatacatgtgtaatagactgtagctatatgtaaacataccagctttcttagatgttacttcctcataaagacctccccctagaccagtgattttcaactagggatgattttgctccccaagggacatttggaaatgtctgggacaaatttgtgattaaagaagagagtactattggcatctaatgggcagaggtcagttgtgatgccaaacatcctatagtggacagggcagtccaccacaacaaagatgtatttggctcaaaacgtcagagattgagaaacattgccgtagatcaattgtcatcttctgaactttgacgtttacacatgcaactaattgtacaattatttaacatctgtacacccattcactgctttcaccactagactgaaaaactccatcagagaccacatatgttttgtgcaatgctataccgcctgtgccttccgcaataagtgacacagcagacactcattaagtataagcttagtgagtgaatagtggataacttaaagttttatagtgtatacatgggacttgtcaagagtctctgtgtttcataaacattgtcgtcatattctagctaaccatatttaaaattttatatatatatatatatatatatatatatatatatttcaccacaagatttttatggtggtgcttttatccacagttataagttctttaagagatattttctatcattaaaaaataaatttatgcctatttactgaagtatttgtgaaaaaagcccaactgacgagtaggttagaacattcgaaatcttcaggttttgatagttttgttttacatccgtgttaaagatgttttaactggctcttcaacattctctaagtaggtagggctggctctaggcaagcacctgaagtatagagttagcttcaggtctgccttccttttcttacctttaggatttcctggtatctttatcctatttctcccaatcccatcttctgctctgtacctctcttgttgggaaataagactcagaatcacagactcttagaacacaacaggactttaaggccacctctcctaatcacccaactgataaacaaattcccatgtataactcccaggtcccaatttttcattatcttgcctatgatcaggtatcataagtgctagaaaacacactattaattgaggcaccagttcctgcttttgaaagttctgatatttagatggctttttgttgagtcaaatgtcaccccccactttagcttctatcgagagactgtgtacctcttggaattattcagcacaagtttaaatttttgtgtccgtaacagtccttcaaacatttgaagacaactatcatctctcttcttctccctgctaaacttccctagatctttcattacctagatgacacagcgtcgaggcttctcaatgtatgaacaactaactaacttccaacttttctctgactggtttaaaatctcttgtaagatttgactgtttattcattacatgaaggaacagcgagaataaggggataatggttccctctgttctctcctcaatgcatatttgttgtatactctttgccaggagctatgctaggtcccgggaacacgattttgggcaaaatagacagattcctttccctcttgctgcttataatacaattgtccctcagtatccatgggggattggttccaggatccccacggatagcaaatccacaaatgttcaagtgacatataaaatgacatactatttccatacaacctacacacatcctcctatatactttaaaacatctctagattacttataatacttaatacaatgtaaatgctatataaatacttattacattgtactgtttagggaataatgacaagaaaaacacctataaatcatcagtacagaggtaggcattcattgtttttctgaatatttttgatgcatggttgcattcacagatttgtaatccaagaatatgaagagcccctgtaccaggtaagagggacattgatggaaacattacagttaaaactgaggttacaaatacgacaagtgttgcctgaaactatgagagcatataataagggggcctatatttaaaagtaacatctcacataatcctcacaatgacccaaacatgcattttcaccttaaatatcaggaagcaaaattgcacaggtattcttaacatggatgccgggtctgggcctcaagaagaatccctggttccttcactctatgagggaggtatgatacccaagactcaaagccaagtatgcatagtcttaactcatagttccttctgacaccatgctttctaccacaggctaggattcaaagtcagccataaagatccagaaatgagtaaaacatacatctagttaaggggagaaggcttaattgctctctaggttgccaatatgaaatgaaaaagaatggctaaccacatctctcagcattgtcaaaatagccaatgaacagagagagcactgcaaagacccccaactcaattcagacttcatttctacctatgtggaattgctgcagccagaaatttaagtaaatgttacttaaatgtaagagccatgtacctaactcttaagtggatatcctcaaatgcaaatatccatttaaaatatacaagaattactgtgatataaagtaacaattgctatgtatcttttacttttgtcgcccagtggcctttagactctggatatatgttaactggcatggctactttggaatatttactcatatatgtaaaccataatggccttaaggactacagataaggcttctttcatattaatcaactatctttcaaaatgtgtaccgcaggctgttctcggaatggagctagatttcagccattagcaaaggtctacaaagtaaaatcactgttactgttaacttttatttttctgattaaacatggatatcatttggatatgtgtccccgcccaaatctcatcttgaaatgtaattcccagtgttggaggtggggcctggtgggaggtgactggatcatgtgtgtggatttctcatgaatggtttaacaccatcctcttggtgccatcctcatgatgatgagtgagttctctgagatctggctgtttacacgtgtgtggtacttcattctgtctctcttgctcctgctctagccaggtgaagtgcctgctcccgttctgccttctgccacgactggaagcttcccgaagcctccacagaaggagatgctgctatgcttccggtacagcctgcagaactgtgagccaagtaagtgtcttttctcatccattacccagtctcaggtatttctttatagcaatgcaagaaaagattaatataacacaacacacagacacatgaataaactcataatacactaattaaaacaatattttgaacattaagaaaacatgcccatgtaattttatgaatgtctttcgtatatcctttcagggattggacgttcattctaacatacctcttatatattgtgcattaatttaaaaaataaaggctttatggcttcacctctgcctgtgtattgatggtgcttttagtgtttcacctttgctgttctgctaacatatcctcaataaatcgatcccaagtgccagaaagcaaataaccctttattttttgcacatttagaatgtttcccccaaaaaggagggagacggtaggtattagagagtgcctactgcgtggtgttcaatcacaataggcccttcgattaatatttattcattttgacatcccaacttgttctagtctgtgatggggtctttaacctggcatctgtggatgggattaagggaggtcccaggatcgcaggaattatattacataaggtaaatacctttgcgttgtgagtcaggtgttacattccatttcacagtggaagattattgagatccagcaacatacccacatcattgataattggtagacatggggttgtataccagctctgtgttactctaaaacacatgcttgcttcaacatgccacactgccttcttacagagctgtgaagaagttgaaatcgcgaaagctattaaagatcaaggcagataaacttcatattatgcagccttcttgtgagtataactttcaattatctccaataaccttaactacatacaaaactatcatacatcaatgatggatacagaattaatctcatttgaatcaaatctttaaaagaatttcaactgttgatataattttgaaaacaaacttttttcagttgaggcataatttgcatataataaagtgcaaaagtctaagtgtttggatggatgtgttttgacaattgaatgtatctatgtattcaccacctgaacaaaatagacaacatttccattaccccgaaaaagtcactaatgcctctgtccactcaattccaaccctcacccagaggtaaccactttcttaattctattaccgtaattgagttttgctgtgctttaacttcatgtaaatacccatatttgtgtctatgacttttggctcagcataatatttttgacattcattcattcatatggttgcttttaccattggtttttcctctattcactgccgagtaaaattccattcatggtttaacagaggcatcaactttttgtgaggtagtgagggaaggaggagggaatgactgcatttcatgtgatacgtaaatggaaagaagcacctagctacacaaagagaaaaggaagagcattctgggtctaagaacagagaaacacgtgcaaaggccctgagatgttttagaaagtgaggaagcactaatatgattatcctatatggattgagaaaggttgacttaagaagaaaatggtaaagatagaaatataatatattcattatgtgttgtaattcattgtattctaagccataataaagagttgggtgttcatcctaataagataaatccatgagggccttaagcacagaaatgcctttatctagctgacattttgagaagatccattttgctgcggtgtaggattgaataggaagagaataacaacagtagtaagagaatgtgacctaatctggcaagagggcagaggtgacctggcctaagatgggggagatgcagaggaagagaaggcaaattcaaaataaatttttggagacagaagttgcattgcattacttgcttatagattagatataaaatgggagataaatgatggaatcatgtggactctgcttaccaatcaagtagataagaagaagatactactgtgaaatagatgagggctggggaaggggaaagattttaaataaaatgtcaaagctgcatgtgcggcagccaatgaattgtgtcatatgctcaggtgaacaagcaggtttggaatcaagagaaatatgggatggaaagatagaggagttattcaactaaagatggcagttaagtccgtagaaatggatgctatcacctaggaggagagcgaaaccagaaaccctaggattgaaggtatagtctcaaactgtgacatacctacctccgaggaatttggaacaactcactgggacacaaaagaaaactgtgaatgcttctatttgtgtttgcatttatatttattgatttctattttcacatacgtttacatgcttagtcatattcatatatgatttacaaataaatgtacattttgtgggaagaaatgtgcttataagttttgtttcaattagaaagcagtcttgaaattttgaagagcattgccttagaggtcaagaggcggaggaggagctagcagaaacagctgaaaagaagccagtgagcttcaacagaagttattgtttcaagaagaaagggagtattctgttgttccctctttctatctgtgcagttgtgggaaatgtgaactcatagtttgtctcgtgtggtcctgttccaaatgccatacttgctggaaatagagtgcagagcatccataaaacagtctataagactaagcatatataaggctgccaaagaagtcatttgttactatctatcttcccattcattttctcaagtctagttcttctgctggcctgtggttagggggtttattctgagtatttccctgtgtctttaaaacttcacatttatatttgatggtattccatgaaatcatcaggttacttgtcaggtttcaaatattacatgaactattttggaaaaaaatgtacatttcaggctcatttccagtcctaaacaatataaattatagccaagtatggcatttagccattaatgctgtctttcacttcagtaatgtaaagaaataataggcttatgacaacttggataatacatttaagcttctacattattgctccagatataaaaaaaatttttcacttcacagaggttctaccttgaagaaagaaaaccaggctccagatataagcctgaaactttcctgagtttctgacttttgccagccatttcatcacactaacaacataaaccttaaatagttaaaacaaatgtaaggcatttatgttatatattcaaatggatataccatggaaaaaaagaacctattactgaatatttagtttgcttcaggcttcgcaatcattatagattccacatttaatatatatatgtgctgattgagttgtcttcattatttcttataaaatatctccaatgttcaatctattgatcatgttgaaagaaaaagggtttagatgagctgtacacatacatatatactctcgggatcatgataaaacaagacaggtggcctggcacggtggctcacgcctgtaatcccagcactttgggaggccaaggtgggcagatcacgaggtcaggagatcgagaccatcctggctaacacggtgaaaccccgtctctactaaaaatacaaaaaaattagcggggcgtggtagccagcgcctgtagtaccagctactcgggaggctgaggcaggagaatggcgtaaacccgggaggcagagcttgcagtgagccaagatcgcgccactgtactccagcctggggtgacagagcgagactccatctcaaaaaaaaaaaaaaaaaaacaaaaacaaaagaaaaaacaagacaggtgactttgaattttaatgaacaagttagaaccctcccccaacatctggttttaaatgctattactttcggtatgtattgcttatcttaataagtatgatgagcttaaatattagcttatcttcgggtccctctcttttttattttaatttttgtgggtacatcgtaggagtatatatttgtagggtacatgagatgttttgacacaggcaggcaatgggtaataatcacatcatggagaacggggtatccatcccttcaagcatttctcctttgtgttacaaacaatccaatcacactcctttagttatttttaaatgtacaagtaactcattattaaccataatcatcccgttgtttgatcagatcaaatagtgtgtcttattttccctgtagaattatttggaaattttctgtttatgttttcatgagctttgggatttggggaagaatttcagcatttttgacttaagatatagttggttcacttagcccagcagtgaacttcagggggtcaatagcatgcaaatatgtatttaaatattaaacatttttgtttctgttaacatcaaaaatttattggacatttaatcttttaacagaaaatatctcatggtttcatatgaaaagtggatgttcttcacattttatttatttcaaataatttacatttatttttacttattggaattggaaaatataagttgtatatatcacgtattatacaacacattgtattgaaaaatgtggactagctaaaatgagctaattaacatatgcattacctcacatactatttttttgcggtgagaacacttaaaatcgactctcttagtaattttcgaaaacatattattattaattatagtcactatgtcgtacaaaagatctcatgaacttatgtctcctatctaactgaaattttgtatcctctgaccaacacagcccttttgtatcctttgattttaaaaaaggcgttgtttaattttaacagtgtcaagacttttaatgataccaggtcctgaaaatgtcagactgtgtttcccatacagtttctttagcatgaaaggggatgtatgcatttgaaatatagtagttgatgaacatcttttagatttttcagtagaattaaaactggatgataaaaattcagcacatatcaactatattccaaaaatcaataaaagtgcctaggagaaacatttaaaaggttaaggaaattaagaaaatggataagataataagataatttaagaaaaattatccaaaacttagaagtaaaacaaaagatgatcgtgtgtgtttcaaaataatggtagcgttgttttctaacaaactcctcacaccctcacaagagcttcaatattttcagagtaaagcaactcttactgtttactattaatttgggcccacacatgttacaacgctatgaagttcaatgcaaattttagaaaactgatatgatgtaaatgactttttacccagtagaggatataaccccaaaggctgtagggtatcaacgagtttagtatcttattcactaatcttattccagaatacttttttaaaaattcactcattatagaagcatttgtttcttgtattctcttttgaaccagttttgtcttcctaccagctctccaattactgtattaaataaaacctaccgtgagttcactatgatttacatgaaaattatgtttcttcataaaatttcactgtgctgataggtggtagaattatgaattttctttgtacttttctccattattcaaaatgtccccagtatactctgaacaaaattaaacatttaattggaaaaaatacatgctatatgcaaatctatttagcttcgtgttgccttaggtatgcaagacgttacatatcatacaaaaaaaatctaagccaccaaagataaaacagttttgcaatcaatagtgtttttccttttctcttccatcagcagcacagcgatgtacaataaggaaataaagtaaactttagaaatatgaaatgtgtatacgtattgacgtgcttattgtgaatgcgatgagaaaggcaagtcaggacagtgagagtcaggttcattacactgcattctcacactataaatgaaagagtagcaagtattggctaaaattcaataacttccatggccaagatacctactataatttgaacattgattccctttgagaagctttctcctgaggcaccatcaagacagatattaataattagtagttcagctaggggttggaccacaaatatcaacctgaacaaactacagaacaccctccacatttgcttcagcactgacagttttgaacactccctggtggccaaactcacttgttttcacctttgaaatgagttagttttcactgagtgctgttgggtactgagccactagcagaagtgaggatgtgcagtctgatgactcacggttgcacgccactaaatactgccaattacacacatttttccccttgcaaattttggggaagggggaggggtgtgaagggggaggggtgtgaaggaggaggggtgtgagcagctgcatataaggagtgcctatactttctttcttttcttttttttttgagacagtcttactctgtcacccaggtcggagtgcagtggtgctatctcagctcactgcaacctctgtctcccaggttcaagcaatcttcccgcctcagcctcctgagtagctgggactatcagcaagcgccaccacgcaaggcttttgtgtgtgtgtgtgtgtgtgtgtgtgtgtgtgtgtgtgtgtgtgtgtatttttagtagaggtggagtttcaccctgtaggccaggctagactcaaacttctgggctcaagcaatactctcgccccagcttcccaaagtgctgggattacaggcttgaaccaccatgcttggccaggagcacctatagtttctacctcaaaaacatagccccctatacctttccacagattatattgttacttttgatattgaacttcttttcattgtaaaagcctggagaaaatttaaggctgtttatatatctgttttctaaatcagcacaccaactgtgaactctgcacttttgaattgggatgagagaatggaaagaaaaaaggttgggagaggagcggagctgggaagaaaggtgatctctagtcctttttcctccgctccctgctccagctcacttttccaatcagtttttataataagcattatttattctcctacaaaagtctcaaagtttactagttataaaaaactcatgatgctttattaaatagggtaaatttgactttgtaaagcaaaaataacaaaatacgtaatttgtaattttcaaaatatacacatgtaatttgaaattacatgtaatttcatattatgcatgtgtgtaatgcaagcacacatgtaacaatacatatgtaacgtgttatatatgtaacacgttacatatgtgttgcatacatatgcacgtgttaggtaacgtgttttacatgtcacatgtaacaatcaatttcacatgtaacatcagttacatatgtgaaaacacacatatgtaatcacacacatatataatttgaaatttttcatagccacatttttaaaagcaaaatgaagtcaatttaattatatattttatttaatcaactataataaaaccataattttaacatgcaataaatgagcatttacttcctttttggttctaagtattcaaaccctggcatgtgtgttatactcagtgcccatctcaattagtactagccgcattttaagagctcagtatcttatgtggctagggggcactgaattggactttgcagctctaaagagagacctcacattgtgatttttattgtcaggcaaatttcaaaattatttctctgcttggatgaggcaccacgtctcactccttgcaaatacatcactctcactaccaaatcctggattagttcagtgttgatgtcatattgttatgagctcacaacacctgtagcattcacacaaataggatacagtggtttaccccttatctgtaggggatacattccaagactcccagtggatgtctgaaactgcagatagtactgagccctatataaactatatgtacttgtgataaattttaatttataaatttggcgcagttaagagattaaaaatcatgaataaaaatagaacaattataacaatacattgtaatgaaaatcatgtgaatgtgatctttctttctctctcttaaaatatcttattgtattgtagtcacctattttcagacagcagttgaccatgggtcactgaaactggggaaagcaaaactgtggatattttgttccaccactgtggagatgtacattatgactacatcattaccaccatctgtggttttcctttaagggtgagactatttatatgcaaattcaaacaccccccccccccccaacaaggaggccatatttagattacctcctggaaagttacttaactctctggaatttgaatttaaataaagagtagacttcttatttcattttgggttttgagaactatatcaagagctcaatatcctgtgaatgaaatactgatcatgcaaacacagccaaagattgtctagggaaaatgctgaagggaactttccaaatccactatagttcttctttcttaccattccatttatgggctgtccacttactccctggcatctgtcctgtgcccctttctgattgtaagtacagtcaacaatgatacaggcaaagtcattcgcttatctgtttctttaagactccagtgcaatgatacaattagacttccaaattctcataagtcaaaaggtacaaatccctgaaaactgctgaatgagtattgaagtgttggcagttacagcttatgatagaatttttattttcaaaagagaaatttaattcagggatatcactatacgtatatccttttatttcctttttgggaactctataagaagccatacttgtttcattgctggatctcttatttcctggaataatacttgtcacacagtaggtcaacaaatatttggttaatttatgtattgagagaattgcttggcacaattcaaccctctcaaagtttatgcaggtgagcaccgtgcagtatagtctcctttggcagcaagagcttaatatctgattttgagagagctgagaatgatacgcaaaacagcattagtttcttccctatatttttaattacagtaatgctgtcttttaaaataagactcctgagtactttatgatcataataaatccatcttaatcgcattcactgctttattttcttttttatttcttttgagacagagtctcactctgtcgccaggctggagtgcagtggcacgatcttggctcactgcgacctccgcctctcgggttcaagcgatactcctgcctcagcctcccaagtagctgggactctaggcatgcaccaccacgcctggctaattttcatatttttagtagagatggggtttcgccatgttggccaggatggtctcgatttcttgacctagtgatctgcctgcctcggcctcccaaagtgctgggattacaggcgtgagccaccgcacccagcccactgctttattttcaagcagaaaacatacacaacaccttcagatggatgctaaagtagaaataaactgtttaaaaatgattgtcatgtggtatgtctgagaagaaaataagcatcacaggatcacaaaatctgttaaatatctgtctccaatcatgacttgaagttgcactctttcaagtatgctaaactgcagttttcctttaaagttcaaaccgtaattataatgtaaaaacccaggaagtatacagcaaaccgtaagtatcctaaacaaacttaaatcttgaaaagtgcaaatctcatccccaaaagcctttgctcaaacacattctgcaactgtggtttataggctaaaacacagacttgtctgtgtaccgtgtaatgtcctttgcaaagttttcctaacctacctgtctggcccatgctatcaccctccatctggaggcctgggatcccaaagcttttgccacttaatattggttgccattctccaagctggcttttccagactgaggtcatctcttctgtttctataaaacttttaaaatacagttattatggaaatttaaaactattatgctatatcataactttgaggtttatgtatctatctctccctgcactagactggctttcttgagtgctggaaatatgattgattccttattccctcacataaaggcaggcatctgcctccctgactgaggtagggtcactgcacaagtagtattgttttcctcaatgttgaaacttttggtctgcagcactgtcctgaaacttaagaaaactatgttgaatgagccaaagaaggctgatattcagggaacagtaaattttaaggaaaagcagttttgcctgtagggaaccatgtcttatggtgggcttttctcttgagggtattctgaaagggaggcaattactaaatccttggctatgatcttcaaagggcttctgccctgtggaaaccaagaggctttcttagagaccatcagcccttgccatacacaatccaatgctcatgtcctccatttgacagccgcttgctaaattcctccgtcacctcagtaacctatgtcttagagtgatatagaatccgccaaatctatatatcaaacagagattaccatgagagtaacaatgtaattgaaggcacttcttaaattatgaagtgctttgttatgttatgactactgttattatcatcaacaaccctaacatcatctctaataacaactccttttaacatccttcttttaatacactatgggtcaaattataattatattaataaatatgttatgtctcaactttactgatgacaatataaaataagtttaattagagctctactcataactaaataacatttttatgaataaaagaagtttcatcttcatcacttaatatatttaaggtctcttaggaagaccttgtcctgtagtcagtggtattattctttttattagtttcctcaagatttattaggcagagcagtgacttaatgtttttggcttaacatttctaacttctagctgatgaacagtaaaaaaaatatggtgtttgaatcccagattcttcatttattagctttatgatttgggataaagcgtttaaactttccgaaatttttgtctaagagttataagaataccttttctacctatcttgctgggagtatttcaaaatcacatgaagtcatattcttggtaatttttaaaacagcatgcaaaagcaaggcactaaaccaactttataaattactgcaatgaaataaatcttgtattacatctttctgtgtatattcttgtaaagttgattttgtactattttccaaaagtattagttttctgaactggcttcttaattttctaaaacttatacttccttacactcaccatattacaaccttgtgacactcaaccagaaatcacccaacacacacatacacatacaactgtgttagtcccttcttgcattgctataaagaaatacctgaaactgggtgctttaaaaagaaaaggggttttcttttgacttacggttctgcaggctgtacaggaagcatgtcactggcatctacttctggtgagagcctcaggaagtttacaaccaaccatggtggaaggcaaaggggagagcaggaaacaggtgggggttgaggtctcatactcttttaaacaaccacatatagcatgaactaacttgtcaccaaagggatcattcatgaaggatccacccacatgatccaatcacacctaccaggccctgcctccaacattggaaatcacatttcaatataagattcggaggtgataaacatccaagccatctctctctctctctctctctctctctctcacatacacacacacacacacacacacacacacacacccacacacacacagtcgcaattaaaacaaaaaatctgtgaaacatctatttgtgatgaatgctgatattttctattttgtttcactaaaaatcaaaggccggtgttgatccacaaactgagtttatgattcacagtttggacaatgaacactagcatactagatttaaaaaatgaaattaaccaaaacaaaaccaacaataaaataaaaaatgtcctcagcattattttgtgccatttctttccatgcatccaacacgcttaccaagagttcctctcatcttgtcattatcataccacaagtttttctgacaccatcacttttcaactttttctcattttcatggatttacaattctctcccttattttcatatcgctctctctatgaagctttcccaattcttctggctagttactctttgggttgcctctgctctgactcatcaatggtgtaccgacctctattatatctattagatgctatttttatggcttaaatgtccatttgctaattataccacttaaatgtttcaattgtttaaatgtccatcaatttcagcaaaccttggattatatgtgaataggttaggattgtatcaatttcaatatcctgagcacctagcatagagcctgacacagagcagctccaaaagtaaaagttttctgaataaatgtgttgatgttaaaggttaggtgaaatgtagagaagtgtcaaagtacacaagatgttcaggttttctaagataaaggtaatctccctggtgtgattctgtcctgcacagctgttctcttgagcagtggtcctttatcatcatctgccttctctcccacctaagtgcgtcctgccacctgatggacgatgatggacatgagtcctctgaggccccaaaactatctttttggttgtgaactaaaggccgacaaagatgatcactttaaggtggataataatgaaattgagcaacagttatctttaagaacggtcagtttaggggctggggcaaaggataaattgcacattgttgaagcagaggcaatgagttacaaaggcagtccaattaaagtaacactggcagctttgaaaatgtctgtacagcccatggtttcccttgagggctttgaaataacaccatcagtggtcttacggttgaagtgtggttcagggccagtgcatgtgagtggacagcatttagtagctggggaggaagatacagagtcagaagacgaacaggaggaggatgtgaaactcataagtatatctggaaagcgatctgctcctggaggtggtagcaaggttccacagaaaaaagtaaaacttgctgctgatgaagatgatgattttgatgatgatgatgattttgatgatgaggaaactgaagaaaaagcgccagtgaagaaatctatatgagatactccagccaaaaatgcacaaaagtcaaatcggaatggaaaagactcaaaaccgtcaacaccaagatcaaaaggacaagaatccttcaaaacaaggaaaaactcctaaaacacccaaaggacctagttctgtagaagacattaaagcaaaaatgcaagcaagtatagaaaaaggtggttctcttcctaaagtggaagccaagttcatgaattatgtgaagaattgcttccagatgactgaccagaggctattcaagatctctggcagtggaggaagtctctctaagaaaatagtttaaacaatttgttaaaaattttccatctgatttcgtttctgtaacagttgatatctggctgtcgttttgataatgcagagtgagaaccttccctaccatgtttgataaatgttgtccagattccattgccaagaatgtgttgtccaaaatgcctgtttagtttttaaagatggaactccaccctttgcttggttttaaggatgtatggaatgttatgctaggacatagtagtagcagtggtcagacatggaaatggtgggtagacaaaagtatacatgtaaaataaaagtattttaataaagtaaaaaaaatgataaaggtaatcacattagaagattcatctcttgggtgcaacagctagggtagcctcccaagccctgtgtggtagtagtcagtatcactactatggtttcaatgtttttccctccaaaactgatgttgaaatttaattgccattgtgacagtattaaggggtgggagctttaggaggtgattaaggattgagggctccaccctcacgagtgggtttggttcccttataaaagtgggagttcagcccccttttgatctttcttgccctctaatcgtccatcatgtgatgacatatcaagtaggccctcgccagaggctgacaccttaatgttagacttcctagtctccagaactgtgagccaatacatttttgttcattacaaattattacctagtcttaggtactttgttacagcagcacaaaacgtattaagagagttacctacttatcttttctgaacatcattacaattccatttcaaaatttctgctcttaatgatatcccaaggagactagaaaatatttcaacagttcagccactcttcaatgaaattatcttgcgtggtcatgtactcgttaaattgccctgaccattctttgaaggatagcactggttatgagattaaatttgaaagttcctatgaactatcagttgagtgaatttgcttattatagcatatatcttaatcatatgttcataagcctccattaagccaggctgcacagtttatttttttaacaattgcattgttttaaagttacagttgtttcagcaatccattactagtatttaaaagtacacacattgtccttttgtaaatacatacaacagccataaattataaaaaaatagaaattcaaggataaaatgtttgaaaaatgtgttatttaagattagcagtaaaattggattttcaaataaatccatgttaactaggatttacaatacaagcctgtactatgagttgtaaagccaggattttgagaactatgctgccacattaaatttattcattttcacagcctgcagacattttaatgcctgagtagcaataagaacaaattaccaaaaaaacttttaatagggtataataaattaagactgaatggtaatgcaaacgtgggtacaacaggacaaaattatgaatctcatataatgacccaacaacacttagagtgtggaaacaacgttggtattctgggatatacgaccacggttaatcctaattgtttttcccttgtcaaatagaaattgcacatcaatctcaaagtattacaaactgttcattacatgcaaatggttatgttctgcaggctctccaaggggactcaaccttctttacaaaaggagccaggctagaagcagagtttctctaatgacagtaagtatccattagagttcctcatatataagcaagagagactgcctctgattcccaaagtcaggttttcccaagtcagactaggtatcccagaggtgtaatggaggactgtcaattagggggcaggaaaaataacagctggaaaaacaacccaccatttgtcctaggccagatccagtactttctggagtgtttacttactgccctttgctttagacgttgtgccttaagacgttgaactcatgagactgtgagctcataaagagaaaaggagctcttagtcagctctgtattcctagcagcaagcagtatctgctttgcacacagtaggatcacaatatatgtttgttacatgggttctggtatttaacatatgctccaatgggtaagagaacagggccatcatattgttaaagtatcaggcaatgtgaaaattttaagtgctctgtacacagaagaggtgaaggaagctcaatgtaagagagaatgttttggctatgaaaagcaaggacaaacttggggatcatttgtctcaggtaatacaataaaagtatcatttttaaatttatttatgtatttattcgttctactgaatattacattttcaatatatgaatcaatttttctacgtaccgaggtatattggtgatcgagaaagaccaagtacccaaaatatgttcattctaatggaaaagataataaacatgaaaacacatactacagtttcagcaagtgacagagttatgaagaaagttaagcagatctcccagaaagagttcaattttgtgtgtgtgcatgtgtgcgtacgtgtgtgctttctttaagatgggggagttacaaaaggcatatctgtgaatataaaattagagcacaaatatatataaagggaagtgtacaaaaattctgagagggagtagattgggacatggtgagaaactggagatagggtagagccctctggtagagagaaaagcaaatttaaaggtagaaacaagcattctagggaacagtaagaagggatgtgaaaagaaaacacgaagatcaatatggctggaacatcgtccttgcaaaatattatttcatgaaaattacttctattaactttaatcttacatttcattaaatgacaatttctgcttctcattgcttccagaatgatggtgcgcagttttgttttgattttttctatttggaatttgcaatcagcattcttctcattttttgtagtctcttactctcttgataatttcatgctctaagaatgggaatcccttagggatgacatgtttatcctgcattttaagcagttctttaccgtggttactacagtaagttatgtttttttgttcttgcttctttccaataatgtatgaaaatctgtcatcttcttaaacatgccatgctggacaacggaagtctaataacaagccactgaaattatccaattattttaatatacttatttctgaaagatacacttgatgggcaaggattgaaagcccctctcggaatttctgcctggtaccacactcccagtaaattggttatttactacttctgaaaagatggataggggccaaaaagttgcagaggagtttccaagcagcaataaaagggtaacaatatttacgcaaggatgaagtgcccaactgtttaactgtattaagagacttaactctcatgccactaccagctaataactttgaaaagctcattttaaaatgtattcccacacttacacattgctgtaaccttaaagtaagtgactagagacaaattctcttagcagtaaattttccggctgattcccttatgctagtgtatgtcttctagttacagaaaccaggatagctttgtgaccacaaaacaaaatcttatgaaattttattactgctggggaaatataaaggacaagcaatggtatgaattattcttaacgttagggtcccagtgaagggcaacagatggtagaaatatttactccagtgatttttccatcaaagtttctatcagcatttgaatctcagcagtgtggctgttaagaagccgtcaaactcagcagccagctggtgaaatcacaatgtaaaaactgactatacagaaaatatacttgtgtctgatttttttacatcatatgcctttttctagattatcctttaattcaatctgtattaatataaattcacttacctcctatagagttctttgaggcagtagattgccatgttaggtgtatcctaataaaaatacgaaaactcattctctgtagcagatactgtcagtgacctatgcacatctattcagcactcatcatttttgtacaagtcaatgacctttcaacggcagtacctgttagataagggctttctgggctgcgagtgctgaaagcaaggcgagaagaatgagaaaacctgggtatttccattaagaggaggacggtcttttcatggactcgcttgtctcaaacttttgagcaggagtcactccaactccattgtgctctctgaatctaaactcttcagaattgggtcctttaaaaagtgctttagaattttcttcaatcactaataaccatggtaaggtaaagctgaagagcagctaaagggagagctgaagagcagctaaacttggctttgacatttttgtactctttttttgccttctctcaactccaaagcaccagtgtgctctttctttctcccttttgttcctcatctgagagatcacagcagggtcaccatgctataactacatgctttatatgtaattttccattctctctggacatttcacatttgagaaaagggagtgtatttttcttcaatagaatatgacgttaaactataagtttttcaacatttgatggtgggaccatgtgaacattaaaatatgacatatgtaatccatatttacttctgtatgctcaatgacaatgaataaatttttactttcatatcacaaagtaaacagttttttattacatttctttacagcaacatatataaatatattgcacatttaccatataacataggttatggagcagtaaaacacactaacattgcaaaagataccagaaaaccaattagcttaaccttaacaagactatattttttccctaaaaacagcagtttattcatgtcagaataacacactggtgtttcgctccccatgtctgcttaacatttgttgatttaaagcctaaaaaatttcatctaaacaataccactactgttaatgtcttaaggtcgatttcaaatggaataccttaagattttagggtctcaggcttgtatgtctgcgacaacgttctgcaggaaatactggtcatttttaatatggttcattcagcagcattatttcataaaacagatgccatttccattaataaaaatattcagctggtttaaatacttaatctaatggtaattgttattgtttctactggcaactacaaacattttccatctcattctatcatagcccatgttttaaaacttattttttcctagtctccaagaacatgctagctttaaatgttagggcattttataatttctactttcctattttcactgaagggacttgaaagcacacaaattcaccctgtcaatatatgagctaacattatttgtgtcactttccttcatggtgttcagcttttcctttgaaaactcccattaacatttcttcttgttagctaggaaatgagtaggcagaagtgtcagctatctgaaacagatgcgtttggctgaattggaattttcctcaattcctaatccaagagcccttatgctttgagaagaaattatactacataaaaataaggttttatgaaatttccaggttggtttttctgcagtgtggatgtttagagacgataattcagtaaataagtcttagtttgtattgatatgaactaatcacttataaagagtgattagttataataggggcttacatttaatgagtaattattttgtgcaaaatgctattccaagtggctttatacacatctcatttatatttccattttagagaagagaaatcagagacatgaaaagaattaagatattttcacaagattctacaactattaagctaaaggacctgggatttgaatccaatctttctgagtccagcatttaaccacttaaccccctttctaaacttctattagagcctcatgtggattgtcactgttttggtggatgataaaactttgtatatgcactcaattactgcttgtttagtgaatgcattaagagatgctgatatcattcaacgaatttaataaaccaatttgagtggcatataacatgatcaatatttttctcaggtaaaaaaatgggatatttttagagaggttctccatagtggcatggtatattgctctggaatatcttcaaaaagcactaattcatgtacttaattttgtcttttacttgcgacagaggaaaaaaaatagagttgcatggaaccagattatctttctactgctattggcagtcagtatattttgaatgataacactaagtctcagttaaagcactaaattctcttctttaaagtgaaaaaaatatgatgcaatttgatcaaaatacatagggacaagtttacaacatatatctatttgtttatttcatatctaaaagttatttctttactgaaaattgtacatatgaggcttcagactccaacgtgcttctgcgtgtgtttgtttaatatatgggctgcttggttgatttttttcacagtaaccattactggctcatgccaaacaattgcctgctaacagccactgtctacatcctgtcttctaaaataatttcatagtaaatattgaaactcattctcttattcattattagtcaatcaacaaaggccaagatagcagaaattaccaaagctttgatttgccttatcgatgaaggtatcttacggggttgattttacccattttacgataattactcagaatggaaagataacctaaggtacattatgtgcgtgtatatgtattcatgtgtgtgtgcacgctcatgtgtgtgcacatgttcatatgcatgattttggacataaaataaccaggaaagaaataccttaactgtttggggggtttgtgatatcattcacagctcttttctgaaagaatttttccttggacatctagaatgatttttcttatctcatctatagattgagaaaaaatagactaaataaaatggtctttttaaaattatccagttggccaggcatggtggctcacgtctgcaatcccagcactttgggaggctgagacaggcagaccacctgaggtcggagatctagaccagcctgaccaacatggtgaaatctcgtctctactaaaaatacaaaaattagccaggtgtgggggtgggcacctgtaatcccagctactcgggaggctaaggcaggagaattgcttgaagcctggaggcagaggttgcagtgagctgagatcatgccactccagcctgggtgacaaaagcaaaattccatctcaaaaaaaaaaaagtatccaattgaggggaaaagttttgataaaatgttcatcagtttcaactaaaccacactgtcaagaaatgaggaccattagacattctctgaaaattttaaattatgatatattcacaaaattgtgtaatgttaatgtattaaaagatcaaattacatcaaaatagtttgttttggacttgttttcaagttggagtaaaggaggctgaacttaatctcctgcctgaaacacctgaaacacttaaaaaaaaaaaaaaaaaaaaaaagacaaaatatatgctacaacggttttcaacacattgaacatcagacattgaaggacagtgatccttgccaggaggcttttgttaaaagatgaagctgagagtttcagcagcccaaggctgactagtgatcacagggcaaaataccagagaggtgatatatacacagaggaaattttggagatttgtagaaagctttattttattcttcatctgagtcttgatcagttcatgtatgcaagaaaaccactcaaagctaaggaaagaacttcacaaaagaattaaaggaaacaatcaccagagctcacacgtggctagtaataccacctgttcccacgagccccagtgaaaaattttatcattcacaggacatcagagagagtactcagaagggttttgcctcagtagtggggaaaaagtagccctaaacttacactgttctggtcataacaaagcataaaaggaagattctcaaaagatcaaattgtttccaagtgaattaactgtgttccagaacgaggtttgagaatatttatttcaatatatttgaatttatttgaagtatcaagcacgcgctaagttaaaattcacaatgtctggcatatagtcaaaaattaccagtcatccaaagaagcagttaaacaacacacttaatgaggagaaaaataaatcaatttaaattaacccagaatagacacagatgataaaattagtagagaagaatattctaacagttattatatctgtattccatatagtcaagaaagtaaagactgaacatgttgagtagacacatggaagaaataaaaagacccaacttttacttctaagagatgaaaatgtctgatgttaaaaatatatactacatgggattagccatagattagactttgaaaaagattagtcaatttgacaatagagattatataaaacaaattacagagaaaagagagaccaaacagacaatgaacataacatcagtgagtagtggggcactttaaggagcctaataaatgtacaattggagttccattttttttaaaaaaatggttgaaaggtttctaaatttgatgaaatgttaaatgcacagattcaagagcttaactgacttcaagaacaagaaacatgaagaaaactacaccaagttacatcaaaacaaattgcttcatcgtaaaagtactccctagttaaccttctacatacaaatctccattttacaatggctttccaagaaacccagcctgaaatatgtagcaaaattcatactgaacaactatcctccaaagagtagaatggaggtacttttacaaatttctatgttacttgatttttttcacaataagtactaatttgataataaaatataaattgaaatatataactaccttgggttggatatcattgaaaatggcaagtggtttctatatctaccccaaaacattttatataactctaatatgtttctgcctctcaggcagaaaccccattatgctacattagcccaaaattcacttcagtgctatttttaaaatgtatcttctatattaaagcagattgggaatccatacatttcctctctatacaaatgccaacgctggtgtgcatgcaagtttgattgatacacatataattacacaaggttttaaaaatattttctgtgtttaaatagcttatcatataaataggtgtttaaatgcttaactccttaatattaaagggcatatttactatggaaacatatttgagaatgaagacttgtaaagtcaaatgtgatactgcttttgtgaatccagcattttgaaatatctaaagtatttaataaactactgggtgttttttgccctcatctgtcttaatcagtattttctggcattaaaaattggctacaattcaaatccacttgattgactattgcaacatgaacaatttgagctaaaaaagatgcaaaaataattaagtcttcgtgtaataaacacagtgtttcttatgcctaaactatgtaatttagcaaccaaattatatcctggacaatctaatctatctttacctgcatattcaaaggacaccacaagttgaaattaaactacacactggttatcatccatatgctgtttccctattaacataaaccataaaatgtcaataagtaccaacaattaactctgcattgttttggcctctggactatttcagaaggcattttgtcaatagaatatatagaaatattgctacagcactacaaaattgtctttaggaaaacagaactgtaattttatcatgatggatatttctagcaacttcattttagctaagtatgccacaagttctccttctggaaaggttccaacataaagccgaaatacacactgccccaaagccacaaaacaccttgctgttacgatgcttccctctgtcacagattcaattatattttgcagtttatcagataaaccagctccgtccaggcaaactctctcatcctgacacaaaaagtccatagcaccgtgctctaatattatcattatgataattttctttctagtaatataatgatgacaacaacagtcaaaagtaatttccatcacccttcagaacctgatctttaagaagttaaagagtccagatgtgctgaagataaatacaatttcgaaaaaacaaatcaaagacttaccttaagataccatttgtatttagcatgttcccaattctcaggaatttgtgtctttctgagaaactgttcagcttctgttagccactgattaaatatctttatatcataatgaaaacgccgccatttctcaacagatctgtcaaatcgcctgcaggtaaaagcatatggatcaagaaaaatagatggattatgtaaaacagattatagagatatagcgtatattttttggttatactgacaaagatatcactctgatagtttcctgcatttgcagagtttagtttcaagtaacaaataaaaattaatatacacacctagcatgtacacacaacattttaaaaaaatactcaatataaaagctgattttaaatggaaggttgcaatttttccctttaaaatgaatatatttattgattaaaagaaagataaagcaactattttggactattggcattttctttcctaaaaatatatttttttaattctagaaatttacaaatatcttaacattgtaataaattatttggaagcaatatattccctttcaaaatatttttggataaaaattacttcataaattctatcactttcaatattattcttgatccaaaactgcctgttcatcaactgaaaggagtaataagttctagtgttctattgcatagtaatatgaacaaagttaccaatattgtgctgtatatttcaaaatagtgaaagagaattttaaattttctcaccacagagaaattataaatgtttgaggctatggatctgccaagaaacctgatttgatcattacacaatgaaacattacactgaaacgtcacactgtaccccataaatacatatagttattacaaataaaactttaaaaatataactaaaataccattatcacaccaataaatcaataattcgtcactatcattaaagattctgtcaatatttaaaataagatgacagatataattcatattgtaggctcacatgtaagcattaaataaccgatatactaaactatgcgatgccttctttaatccttcttattttattgtagtcactaaaattttagattggaatactgcaggaacttagtacaagtcaaatgtgttaatactacacatggaaagaatattaggaaacaagcatttggtcaccttccagtcataaaagagactgaggcagaaataatatgaaccagggctgtatgtttacctaagacagttgcacataagaatcaactggggcatttaaaacacagcaacaacaataaccaaacagtgatcctggggctccattccagaccaacttaatcagtatttctggaggttggacactgacgctgttatttttcaaagcatccaggtgatttcaatgtacagtcaaggtgaaaaacactgccgtaaagtaagatttgaaatcttactgggcttacagtctaccagatttcctggggcctgcccaagcaagcatttgtgagcacaaaaccaatagccatcctacagattaccggctatggtgctgcctcagagtacaggaatctgtcaagcttttctgaactctattcttaagaagcaatggatcatacttttgaataccatgatatcttttcagtcctctaccttcattcaggaatttaaagtaacactagaagttttaaattgctacatctgcctactgatgtcctgggcagagaaaggaattaacatttattaaacagttactaatagccaggcaccgggctctgtgcttttatagtgccagacacatcatttcattgacacctacaataaccctgcagcataacaattattattcccattttccattggagaaaacagaggccaagtaatttgccaaaaggtgaaaatggtattaaatagtagagagaggcttctaacccaaatatctcttgtttcaatggcacttttctaccagtgcacatgctctcttgtgaaattatttttccaagatgaagcttcactttatcagttaaacaattaaaagtgatagttctagaggttttttccccttatttttattaactacccaaaatttaataatgtatctacatgtacattgcactcattgtatttaatgaataattatatgcttaacctttaaaatcttgtaaaacagacagcattttggtagcataaaaaaggcaaccgaaggtagccgaagaggtattctctaactgtagttagtgaaaaataagaatgttgcctttgatgatttatggtattctagagttattcagatacaatatatccttccacaacaaaatgatcttgccaatgtttttgcatgtttactaataatttagcattcatatattttcaatggtatataacacacaataaatgacctatgaatatatcgtaagtttattccctttaaaaatgaattgcacattgcatatgttacatgcatttgcatcactggagtcaaagagttgcttttgaatgagaatctaaaaatctatgcaacatagttagcattgttccatactggtgagactatattttcttatataatttttctatatttttcaatttgtctacaatgtgcttttcatattgagagtcagaaaaatgaaataatttaaaatttttttttaaatggcagtctcatatgcaaatgactgctaactccaaccctcctcctgctaccacagtctgagaaacagtcagcagctaaccagagcacagagaagtaccagttggtcacgacttaccactccacctttgtagcaaccatcagtctccactcttggtttgctgtttttcctacccaatcacttgaactatacttttgccaacacttttagctactaggaggtgactgtttctctgacatactgctataaatgcccattcttcatttcaggatcctgtacacctcaaagattttcgatttcaaacctgttgcacagacttgtttctcaatcactcatcatattggtaattgccatcctctatcaaattcaacaaatccccctctcaccctgaattcttttcctttttacaagttatctacaagtttctacaagttatctttcctttacattctcccaagagaagaaaaccgtaagggttcatacacttgctcatggtatccgtagctctgtaagacagagctggaggtaggaagagaaggggaacaggccttccacttacaccattgttccaggcccacaagagggaggcaggatggactttctgcccgacccctgctactgtcttaggacttgtgaatttgcatatcggtagcatatttctgaaatgcccttcttccctttttctctcgtctcctcgtataatccaaacttttgcatcctcaaggacctaataaaaatgacttatgctgtcactttataaatatataaatatgaagtatttattacagcatgcaactgctaaacctttgaaaactgtaaagttgatttaattttattattgaaattactgttgaaataagtaactattcaaacaaaatattaaagaataaaatcatgggctttacatgtgatgacacttaatgtgagtaataatactttagactccatttcaagcctcacataaaattttaaaatacacttttcagtatttaataggtgctgttaatagcacagtctaaatctattcttgaatttactacgtaaaattacattttttatcatgactacttttaaactcttttccaccaaggaaaattccaaatgaaaaaaatatatatatattttttctggttttacaaagttagatttaccaatttaatatctaattagtcactgtgctccctaaatttgtctcgctccattaattgggctgcccatgaatgaagcaaatggtaacaatgagaaacaagtagagacatcaaaaatagcattcagggaaacaaatataatttttgccttctgtaatatttctaggaaaaaaagttttttttcttggcagtaagaagaaatatggatggaacttaacaaagggcaaaaaaatgtcagtataaacataaggataataaatcaagtgattttagaattttgcaaatattaaaattctcattcaccgtgcaaccggtatttaaaattacactgctgcttcatttatgtgcagcataacttattttctgatgttctaaatcaagttagtcagattattctcaagcataaattacatttagggagtaattcggtactctggggcatactttaacactttcgggccattaaggtggtagtaaattccatgaaatagatttaaataaataacaccctagtagacttctgacatatccattgttgctttatacttcggtctggaaactcagcattggactgctgattatttcatcccatcccacatatttcatctttgattaggtgaggaggagggacctgagctcgtgtctcatggtccaaactgtatgtgcgaataaataagttagttatctgccccaaatcatagtaccttgctacttctccccaaccctcaacttcccaagtaatacaaatatttagtaaaagataagtatactaccaattatgaagtacttacctcctaaggttaattgtgggagctcaataaatgagtatatataaatttctttttttacatcttttattttattaatgtttttaaaaaattcaaattcaatagtctttggaatacaagtgatttttggttacatgaatgaattgtatagaagtaaaatcagatattttagtgcacgtgtcacccaagtagtgtacattacaccccaaaggtaattttttatccctcactaccttcccactctgccccttctgagtcttcaaagtccattctaccactctgtctgcctttgtgtacctacagcgtagctcccacttataagtgagaacatacagtatttggttttccattcctgaattacttcacttagaataatggcatccagctccatcaaagttgctgcaaaagacattatttcattattttctacggctgagtagtattgcatggtatgtggctgaatagtatttcacggtatatgaaaatatatgccacattttctttatccactcattggtcggctggcacttaggatggttccatatctttgcaactgtgaattgtgctgctataaacatatgcgtgcaagtgtctttttgatataatgaattctcttcctctaggtacataatcggtagtgagatttccagatcaaatgttagatctacttttagttctttaagaaatcttcatactgttttccatgtaggttgtactaatttacaatcaccagcagtgtacaaatgttccgttttcatcacattcacaacaaaatctattcaaaacctctgggatacagcaaaagcaaggctaagaggaaattttctagcaccaaatgcctacatcaaagagcctgaaagttcacagtctgactacctaacatcacacctgaaggaactagagaatcaacaacaaagccaacacaaagctccagaagaaaagaaataacaaagatcagagcagaactaaatgaaattgaaacaaaaatataaaagatcaatgaaacaaaatgttgattctttgaaaagataagtaaaattgatagaccagtagttagattaaccaagaaaaaaagagagaagattcaagtaagctcagttacaaatgaaaatgcaaatttcttaaaacagcatctggcagtgttccacaagtatgagtagtagtagttgttgtcattattagtgtacctctatttggcttaagactttaaatgcaaataaaatgaccaacatagaatctgagccatgctagtgtctctctggtggggaatagacccacccataaattagaaattccttcttgagaaattaccttctttaatttcaggacttaaagtatttaaataggcagtgtcattagcctgctgatgaaatctgaatcattatttcagcatagaatccatggttggccatgcctatccctgagtacattacatatatttactttttaaatgctttttgttgtgaaacataatatagggaaccattcatataaacccatggtgaccatcacccagaccaagaaataaaacttccagcagccaaatggaacactctatatcatagtttcaagattaatctacctctttgcttattagttgttgattaatttctcactgtatgattgtcttagtctgtttgtgctgttataacaaaatgcctgagactgggtaatttacaaataataccaatgtattcactcacagttctggaggctgggaagtccaagataaaggctctggcatttggtgtctggtgagggccttcctgctgtatcttcacaaggcagaaggtagaagggcaagagagcaagctgactgaatgctgcgtgaagccttgtttataagggtcttatttttattaacaaagaaggagccctcatggcctaatcaccacttaaacaccctacctcttagtactagcacattatcgacacctgaatttggaaagagacacattcaaactatagcaaattttactattaataaatactgaagtagttttggtttggggctattactatgctgctatgacattcccaaacatgtctcctggaatatgaacatatgcatttctgtagagtgtatatatagaagtgaaattggtgggctataggttatgcagatctttgaatttactaaatagtgccaaatggatttcactccaagaagcagtagtgtaattttacacttctatttacaattcacagaccaagtaacattgtgtgaaatttctaattgctgtatattctcaccaccacatggaattgtcagacttataaatttcaatgattctggttggtaagcagtgatatttcattttagttttaatttgcatggcctggaccattaatgggacttagaaattctttatatatttattggccgtttggatttcttattttgtaaagatgacaaaaatcttaacgttactatgatgcataaaacacattagttatttactataaagtgatcaccttaaaaatgccatccaggtcaagatacagaatattgccagcaggccacaagccctttttgtgccatggttcacttttcaagaacttttcccatttttctattggattatctgttcttttctgaaagatttgtaggaattctttataattatgaatacacacatttcatccattatgtgtgtattccaaataatttatcctactctgtgggtttcatttttactctctcagtgctgtcttttgatgtatagatgttattaatatacaaggtagtccactttattatttttattcatgattagtgcttcatcatttgtgtaagcaattttttcttaccctatattaattaacatattctcctctattttactgtaaaagctttatcaatttgtttttttctcatgtcagtttttagtcacctgggattttatttttgtatatagtttgaaacagaatatatacttttttcctaagcaggagactccattttaattttttaggtaaaacatgtgcactgtacaagataatgcatgaacagcagaaaaataaaagtgtgtgcagtgaaaagcatctgtcccaattttgatctgctcactctggtagttctgctctcactgttaataaaaattttataattttaaatatttatagaacaaggcaaagaaataaacacagtgatataaaatgatagtctcctcattcagttttactgctttcaatatattcaatgctgatatttttacaactctggattgacattatactttgtaacactctattttattgatccctaatcctccctaggttgtgagccttgttctcaggcttcaaatacgtttggagtcatactttgattttaagtttctcacagtgtttataatacttgagcttaggaactcattctcatgcctttatcccctctcttcgctgttgaaattctacacattttttcccttatttctcataacttcacttattgcattctgaataaacagcaaagataaattttctttgacctgtaccaccaacatcaacacctaaagtgacctctttcccattataggggactcttctactgtgcttaatggagactaggatgtgttcccctcaaaggaattctagtttttataggtaaacttgttaaatgtcttgtatggacactgccttatgaaacctcatttgctttcaaagcttcaactaacatctacagcaggtattggcaaactttatagataaagatcttgagaacaaatatttcaggctttgtgggccgtatggtttttgttacaactactcaactctgccttgaagttcaaaaaaaaggtatacatggagcataagcaaatggatatggctgggattcaatactactttacaaaaacaagtggtgggtgtaattggcccatgggcaggagattattgactcttaatctaggctgattatgacatagctccaaatttcagcccttatctgaggtatatagccaactgctacttggactatcctcatcagaacatttgatgtgaacctcaaagatgttatgtcaacaattccttattttcccatgcaagtctttgatatgatttggatctgtgtccccacccaaatctcatattaaattgtaatccccaatgttggaggtggggcctggtgagaggtgactggatcatcagggtggtttctcacggtttaataccatcctcttggtactgtcctcatgaaaatgagtgagttctccaagatctggttgtttaaaagtaggtagccacccacccccaccaccaactctctctctctgctttcgccatgtgaaatgcctacacctgctctgccttccaccatgagtaaaagctccctgaggcctccccagaaacagatgttgctatgcttcctgtagagcctgcagaatcgtcagccaattaaacctctttactttataaacacccagtctcaggtatttctttatagcaatgcaagaatggcctaatccagtccttagttttaattttagtcaatgatttccaagctagaaatcttgagaccatcgtttacttctcgacttctttcttatcatgcttgtctctatattttatcaattctaaaccagaaatgactctttaatttagcctcttctctctagccccactgtcgtggcctttcttgaaaactcctaataacttttcctcagcatattccaactcatctctccctattttcggtttctcagcgctctctaacagacaacctcacttcctactttggtccctatacaaacattcacatagcccaccatgtatactgtactgaaaacatagaaaatctgaaaattttcataacaaccaaaattccttttttactgtgggccttttgctgtattttagaatgacaccctatctaaaatgtcactattccataaggcttctctcccttggaattagttacttcataagacaagcttccacagctttgtgaaaacctctattaacatactacttcatgttctaattatgtatttacaaggctgtttgttccagtacactatgtacctcttagaataaggaagatgttttatgcacctttgaattcctggtactaagcgctgttcctggtacatgataaatgttgaatacattttaataactgaatgaatgaataaaaaagtccatgagtaatttcacaaaccccttatatcttccatttaagagccatgaatgcttggatacactattttacctctgagtctcagttatctcacacataaacccagaataatactgcctacctcattcagctttttcaggaggatgaaagtacactccaagttataaatagcaataaaatttagtattatcgatattaatacagttagtaatctataaatttttaataccgacacagaatttagaataaaaaaatcaatctacatcagaaatcattttccaaatatatcagcaatcacataattgttgttttcattaataaaagacacaaaatgatgattcttaaagataaataatttagcaagttcaacaccatcctaaaaagaatacactttgcacaaatttactgagacctaatttaaatatgaggatgcacatttagggactgtgactcttttaaggtgagtgttttaaaccaaaacaatattgataaaattcaccctaaagaagtcaatagcattatttaaaaacagatgattggataaagaatatgtggagatatatctccacatattcttttatttatatgtgtgtgaatgaatgtattccattgtgtagtattccattgtgtgtctatcctagcttctaagtctaagcatatatatatatatatatatatatatatatatatatatatatatatatgtacacacacacaaattgcgtatggaataaacaatttcatatacacaatgaaaaatactacaaagccatagtaaagaatgaaatcatgtcttttgcagcaacatggatggaactggtggtcatcttaagtggaataactcaaaaacagaaagtcaaatattgcatgttctcacttacaagtggaagctaaataatgtgtacacatgcgcacagagtgtggaataatagacactggagactcagaagggcgagagggtgggatgggggcgaaggataggaaattgcttaatggagaaaaggtacatcatttgcatgatgggtacacaaaaaaccagacttcgccactctgcaatatatccatgtaacaaaaatgtacttgtataccttaaatttatacaaacaaaaaaataataaaattacttaaatgttgattgcattatttgtaagaactcacaaacaattcaggttatcactaagactattaaaataaatcttaaaattctttagatttctaaagtgttgtttaaactttgctggactcttattgggcttaaatctctagacaggcagatctgtggaggaggacgctgtaacagaaaagcctcatcaataagctgaaattgctttagataaacgaggactttttgatctgaaagtgcacacaaaaatacatatactttaatatgtatataagtatacacacatatcagaaacttggcctgagtgatttttagggggctaaggggaccttaattaagcactctattttggcttaggggaaaacaccgtaaatatccttgagataaattgataagtactcaaatagttagagattcatttctttacctatgcttggtatctgattatttaactccttagtaataacaaagaaagcaaaagtgtccctgatattactattgtctagaactccgcaaattttctttgcccttctcttttataaatctctttgacacaatataatgttccagcagacaactgacaatgtaaaggttgtgatatttgaaaattccatcatgatggaaaaatattcagggtgtactattcctgcactgcttctgaaaaaatatgtaggattatgctaatattaacctaaaattatgcaatttcaatgtcttgatttggcacaattagcaccctgtaaaaatacccaaagtagcagaaatagtttgctattagtgatctgtaatgctacttttaataccaagaccttttggagaaatcagctacagaaactgactcagcaggctaagttaaataatttaaatttcttaataagtttaaactgacatactctctgaggatttgatatattcaagggtctcctttataaaatgtgagcatttaattgagtcttaatttacatatcctctactatatagtccacatgaagaggatatggtgttagacatcctagcttccaagtcttagctttcatttgttggctagaggggatatttgaaataatgatgcctttctcttcattcaaacacaaaacatatataataggtgtaggaacttttacccagaaataggagcaaaagcaaccacaaatatatgctatgcactctaattaaaacttcagattaagtacatgattaaatatactccacagcaccttggggtaggtactatcattttattcattttgcaaatgagaaaactgagactttgggagtctaacttgtatgtttctaatcaggaatgcaagacaataacatagctgaataaggatagcttatagtgtatgttttttgtttcttgttttttttaagtgtcatttgaatcagtaaacactgtattagcttgtgaaagagaaaaaatcctacttctcctataatatactatcctcttggaaataaatcatgttgttattggatagttacactcacgtgtttctgatcatgaaatttatatttcaaaggaatggattaataaataacctaacctcctttctaagcagcatttgctcaaaataacatatttctagacacttctcattatatatcatgacaagtacctcatactctcaaatcaaaatggaatttctcttgatttttcagaaacatccttggtggttcttcatcttttggtttatttttgtttatattattccttttcttaaagtatcgttgcttatattgtcctaaatttttctataccttcctccatgagaacctttctgatactaccaattagaagtaatccctcccctctttaataacactctttttattagggtgattatttttcttgattcttttttgtaaccaccttaatgaagtatgattgacatacaaaaagctgtacatattttacatatatatatatatatctcaaagagtttcatcatatatatatatatatatatatatatatatatatatatatatataaaatcaaagagtttgggaataagtatacacccacaaaaccatcgccaccatgaaggctataaacatatctgtcatcactcaaaatttcctcttgtcccctttattattgttgttactggtggtaagaacacaacataagatttcttaggaaattttaagtgtccgaaacagcattattagctataggcactatgctgtataatagatctccagaattttatcttccataactgaaactttgtagtctttaacactccttttgtcctgctttaaagaatttattctactctaatttacattagtgtcattacgtctaaaccacactaaatgctccctaagggtagaaactatattgaatcaccatttttacctcctataacaggtgccaaaaaataatgttgcacttaatttttgcagattcaaatttatccataagtaattttaatacaaataattggtatccacttcaaatgagtataccttctgaaaagaaacatggttttttttgttttgttttgttttgttttgttatttttgagacggagtctcgctctgtcaaccaggctggagtgcagcggcgcgatctcggctcactacaagctctgcctcccaggttcacgcctttctcccgcctcagcttcccgagtagctgggactacaggcgcccgccaccacgcccggctaattttttgtattttttagtagagacggggtttcaccttgttggccaggacggtctcgatctcctgacctcgtgatccttctgcctcggcctcccaaagtgctgggattacaggcgtgagccaccgcgcccggccaaaaacatgttctttagaactcccaaagtatcatcttttagtatgaagattttttttgaaattaagaacaagtagtaaaacaatcaggttgtacagcatacaaaatttgaagacaagcaaacgtgagtttgaaattctgttttattgcctaacagtgctttgtaaacttcagcaagtgatttaatttcctgatttcagagttctcatttgtgaaataggcataatatatatttcacagggttgttataagaattaaaaataatacagtgaagttttctgagcccatagtaagtgctcaatggtggcaataacaataatcataatatccaaatatatatacagtatataatttctgttatttagaaaatattaagttatcaaatacatgtacacatatatgaatattttcaatatctatgaatgaggaaaatatgtataactgattttatacatttcctcattggcacatgaaagttgtatatcttcagctaaatttagtcttcttgccctttaaggctcaaacattttactatgtgtaaatgattttactgctattgtaattgggcaaaccaaaacaattacagtaaatggaatcatatgtctttgtttcgttctcaacgagggaggaacagtacacttaacacagctacaaaaaaatttaacttacttttttctgctaaaggaaaatgagatgaaaaagccattttattttaaaacgaatggcagattttgatttcgaggcaagtaaggcaatttcgtgttatcttcccaaaagtatggtgagaatacgaattccaaatatgcggagtatgaataaaaaatagaaaggtatgacatttttcttcttaggcagccaaaatgatatttcttccataggctgctgcggcaaatcaaaatacaccacttgagatcagcttacgaaaatgtcccttttacatgggactcattttctttggccataaaaaattaaagattaagatctctgtctatctttgaatatatatggcatgagaccacacttacaaatacataaataaaactgaaacaattcactttttacttagctttattctaaacgggaaattctattttctctcttactactattctactttctctattttctctcactggcaccattaccttccacaagactgtttttcctgtgaaggtagttataattaacaagagcctatacacacataaaagttttcatttaccatattagtgaacatatcaagctatcatttttcttaatgtttactaagttttactttattgaaaccaatctcaaaggttgcagcatttaaaaaagtgacatttataattctcaattataaaataattttccaaagaaagaaaaaaattccaattttacttttataagttggaatttactatatatacacacaaatatagtatgatttgtgtgtgtttgcaacacacaaatatagtattattgaaaaaggaggaatttagatgttccaagtggcattaacagaaaattagttctgaaattatgccagattagcatttcaactagaaattatgccagattagcatttcaactagaaatagcaaggaaaaacttctaggctataagaggtcataagtagtaaagaaaataagaactattttcaggagacatgacctattctgccgggagttgcacccataaggcagagggaacgggtccaaaatattttcttataaaaatagagatacagtaattaatttcaaggcagatttcagtttatctatttttgataaatttgttaaatcaattaaatatgccaggggccccttattaggagtatggctgtaaggctaattttagtttgaatctactgacaccataaacattaagaggatttcacccccactcctacccactccctagcctgtatgtaactgtgggagcagggcagttccaggatgacaccatgttagaaagacaacttcactgcaaatttactgaactgaaatctgacccaagtatagcagctctaagtcaaagaaaatgtcatcacatctgacttactaccttatgagtaaatatcatcacaaaagtcgggccccttttgctattttatattctatcttattaaaacacaggtgcacgagggaaatgttcttggcataaaactactacattcattaaattttttctttcccacaccggaaggcacatgtctaaacctgtaggggttgctttattatttaattagagcagattcttttctatcattttaggtgtttcatctaaagtttgattaacatcagtatatgctgtgctctcaggcaagtaaatatagctgccgtagaaagagaaataagcagaagcaacattttaaaaaataaagaataacatgaacatggaaagaaaaagaacctttaagaaataaaatatccacaaagctcactagaaatgcttcctaaacgtgtatgaagcgtatgtgtttgtacattttatttcaccactgattcatttactcaatcttttgataaacatttattgagcgcttagtcctgaggctagcagtgtgttgaattcggaaggtgtaaagctgaaaaagatactatctctatcaatgggcaattgacagtttagttgcacagtattttaaggagggtatgaactgaagttgtagcacatgctgtacttgctccatgcacttccccttgcctttccatttcaaaatacactggtttgacttccaaatgccagcatttggatttcattacctatggaatctttctggttgcagaggtctgatgctgatgttactggggtggggagcatatttttcaaccagtggcatggaaggaatggcccaagggctagttgggcaagatgtactagatcaacattatgaaggttcatgaatatcaaagtttttgagttcatttatgcagaagtagtttattgcaaaagagtaccacacaaaataaatagctgcagatctttcacaatacaataaattaaaaaaacttcttggagggggagaatatatagagcattcccaatccacttcctggtacaatttctttttcttttatttatttatttatttatttatttatttatttatttatttatttattgagacggagcttcgctcttgttgccccagctggagtgcaatggtgtgatcttctctcaccacaacctatgcctccagggtggaagagattctcttgccttagcctcctgagtagctggggttacaggcatgcgccaccatgcctggctaattttgtattttaagtagagagggtttctccatgttgctcagtctggtctcgaactcccgacctcaggtgatccgcccaccttggtctctcaaagtgctgggattacaggcatgagtcaccacacccagcccggtacaatttcttaggcttcattttgtgccaaaattgtatatatatgtaagctatacttcaccatgttttccattaaccctacaactgcgatttcggcagcttcatgcttctcaagagccatggtatgggtcacagtaaaactggctggtccaccaaatagacagcagggacggcagtggtgaatagtcccatgaccacgagagaccagaaagaattagttgtctatagctactcttgtctgtgagattatagttcattttcgccttgaaaggaaggttttagttatgttgggtcaggaaaagacagatgggttattatttattgcctatcagttttaaccacgtgcaaatgaacgttatgcaagatgagagcataggagaagctagaagtctaatcagttcttgaagaaggaaagtgaaattgtgacatttgacatttaaaaatataattttgtaagctataaagaagggggtggtgagaagttagaatagtggtttgcaaacttgctgtacaatggagtcatccaaggatcttaaaaaaaaaatacaccagagatctgattcaactgatttgggacatggccagggcatcagaattttcacccaatattttaacataacaaatttcaaaaatgcaataacatttttaaaaattacaagtgatatctatatatctagattccaccatgaacattttactatactcgttttgatcacatatcttttccttcctccgatccatccatcaatcaatcatatttttgatgcatatccaggtaaactgctgacatcagtatcattcaccttaaatacctcaatatggatatcactgaatagaattcataaggtttctttattattatgttattatttactgtatttggtgtcctctttaccttatggccaattcaagtaataactctgcaaggtagttattacttagaaggaaaaaaagattcagagacattaagtcatcttttaatgttcacatgggaagtaaaaggtagagttggattcaaatccagctttcacttatcccataaaacagtggtccctgacccttttggcaccaggaactgattttgtggaagacaatttttccgtggaccgggttggaggatggtttccatatgattcaagtgcattacagttattgcacacattatttatattattatcacattataatatataatgaaataattatacaactcaccataatgtagattcagtgggagccttgagcttcctttcctgcagctagatggtcccatctggggggtgatgggagacagtgacagatcatgcagcattagattctcataaggagcatgcaacctagatcccttgcatgagtagttcacaatagggtttgtgctcctatgggaatttaatgtggctgctgatctgacaggaggtggagctcaggcagaaatggagtgatgaggagcagctgtaaatacagatgaagcttccttccctagcccgctgctgctcacctactgctttgcgaatcgggtccctaacaggcaacggattggtacgggtctgtggctctggggttgaggtaccctgccataaaatactatatttttttcatttttccaaatgtctctaatgctatgagggtagaagtggaaaggagtcgaattagatatttaatttgaagtctacccattacaattttggaaggttagaggccaaaagggggtgtatcttgttttattttttcaactttttctaacatgacaactgttgaaaaataagtatcatgtacaaaaggtaaataaaagtggccttcactttgttttcatttggagtatttattcatcttataatgccttaacatggatttttaacttaatgaaatcgcccttaaatttgtcattaacagactattgttttagttttagtgttttttaactatgaaaatattgtcattgtattaaaaaataagaatttccaagttacaaaatgacagtgaaaaaaaccagccataccattccaccctcacataacagctatcaggatgaagaataatttttctctttatcatttattagttctctaacctaattttttaaggaattcatttaaaatcatggtaaaataaaatgaaaatataactaataagatagtatttgaggtgataggatttcctcctcagcaatgaaaatcttacataatcatttaaagaccggtgaagtgctgaaaatcagacaaaattacaatgtgaaaatcatcaagaggaaacaagtctattttaaaggaatgccaattagactgacaacttaccgttcaacagaaaatatggaagcctgagaacaatcatgctatcttcaatgtgattaactggaatgctgtttggtaggacatgccatcctcagtttaactagattattgctaaattacactctaaattggttgtaccaacttaaatttctacaagaatgagagtttgtgacctttcacaatcttattttattttttacttgttccagtccgatgggagtacgttatctcacttagtacgatatggtttggcagtgtccccacccaaatctcatcttgaattcctacatgttgtgggaaggacctcgtgggaggtaattgaatcatgggggcaggtccttcccatgctgttctcgtgatagtaaattagtctcatgagatctgatggttttataaaggggactttctttgccttctgccattcatgtaagatgtgacttgctcctccttgccttctgccaagattgtgaggcctccccagctgtgtggaactgtaagtccattaaatcctttttcctgtataaatgacccagtctcatgtatgtctttatcagcagcatgaaaaccgactaatatgaagtaatttttccaataataaatgagagttagcatctattcataagtgtatttgacatacagatgttctgtgaactgtctattattttttaaactttaaaaatattttcctgttaggttatttttattttgttctattgataggtaaatatttttcttaaattatgacataaatcctttattgttttagtattgcaaatatactatctgagcctatgtcttttctttgtttatgaagtctttgcattgtacaggtttttaattaaaatgatcaaatatatgtctttttctttacaatttttgctttgtgctgttgcttaagggacacctcttttgccctacatgccccaaaatatttttatatattttaatgctttgcctttcatgtttaggcaatccatcaatttaccatttttatgtttatgtacagtgtgagatagggatctaattcttatgtttaataaaattttaaatggtacttctgtctgtcatacatgtcatatattatactcttacacaataagaataccacctctcaatacattcgaatacattagattttttttttcttggtaacaaaattcctggagcactattttcttctccaatctgtacaggtttctctctacaactgttatacagctgttgttacaggatctcctccaccatctttctggcaccactttgcatcttcctcccacgttgggttctctgttttccggatcctaggctttgcaggtaatactaatgctccaatattttcctaattctcttacctctcttaaaaatattagtgattataatcccctgtcccctcagagttaggcatgaccacgtgacttcctttggatgatgaagtgaaatgaaaatgacatatatcactcctacatagaggcatgtaagagtcagtttaaaattttccacgcatttttgactgacatggtgaacgctaaagcttcttattgttacggtagaatgatagaatactagagactgaatcagcttagattcctgagtgactacaatgatcagaacccttgactgacttgtgttggatatgttgcaaagatacaaaatcaacctttgtgtttctagccactaatattttggaattgcttattattgcagcataacaaggcgaatcatgcctaaaacactctccttctgatctccaatcacaactaaacattctttgtctttcttggtttctttcttcacttggtagagtatatttttgaaaatagatttctggggaaaaaaggtttaggggagtacataaggctatctctgaaaattattttctccgcacaatttatagtttatcagggtgtacaatttatatattgttgaataacaagtcattccaaaatttagcagcttaaaaacaaaaatgtttattatttggcagtttctgaaggtcaagaatctgagagtggcttagcagggtgggactggcatagcttattttatgaggttgtagttaagctgttgtctatgcttgcagcctctcgagatttgtctggtgttaaatgatgcacttctaagctcattcttgtggctctttgcaggaggccttagtttctcagcatacgtgcatctccatagggctgctcatgacatgtgttcccacagaagaagcaatgcatgagagagagagagagagagagagagagagaaagagagacacagagagagataggcgtggatggagaacacaagacataaaccacagtctttctacaacctacacttggaaatgacatatcatcacaaaagagtcactgaatctagtccacactcaatgacagggacatttagctgtaactcttgaatagaagagcatcacagaatttgtgaacataatttcatataggatatgaaatcaaagccaaagttaattattcctagaagtttaaaggaagtgttcctttctgctattttccatggctattgctgaaaagtccaaagccattctgatttctgatctgtgaacttctctttgtccttgtttttgtaaaaatttatgatgatgagccttggtgtagatttttagctcatttgctgtgctgggcatttagtaagccctttaaacctggacactcattttcttcagttctaagaaaactgatgttgtcacttctttgataattttctctccacagttgcctctcttctgttttatttttaacatctattatttgaatgttggattacatagaacaaggtttctaaacataaacactattgacactttgaaatgagtaattcttggttgtggatggctgcatggtgcattcctcttgcgtcactcttcacaagaggccagtagtacatcctttccttatttgtgacaacgaaaaaggtctccgtacattgtcaaacgtcctctgcaggacaaaatcacctctatttgtgaaacacttacctagaatgatcttctaagattcttatactctcccattttccatgcttttggctatttatactgctttatgagatatttcttcaaatttatcttctacttttgaacttttatttctgctcttcatttttaatagacttgattttttaaagcaattttacatttatagcaaaatcgaggggaaagtacagagatttcccgtatactctctggcccccttcctcattacacacagcctaccccgctatcaacatcccacaccagagtggtacatttgttataactgacttacatacattgatatatcattaacactcgaagtccatagtttacattagagtttgcttgtgatgttgtatcttctatgggtttggacaaatatataatgaaaggtatccaccattatagtatcacacagagtagtttcattgctctaaaactgctatgcataccatgtatgttattccagtggtggatatactaaaagctctgccttcaccactataaaatatattcatataacaaaattacactggtaacccataaatttatacaattaagaatttaaaaacttaacctgctatactattaatttaaataacccttatctttctcggaaataccaccttctatagtctcttgttctttcttatgaatacagtgactagtctcactgtgagataataattttatagctatctttaaaaagttttcttaaggtctatgccttgtctctctttctgcagagatttctgtttcatttatgtggctattgtttttttcccaatatttctgctttttgtttttatgttggtttctgtcttccatctttgagacatgttcaaatatctggaaatccttgattgtctcttaaaactgaggcattaaatgcttttggaaattccttgtgcgtatgtagggcttatacttggtgggcttcaatatatggtcattaggcacagatctggctatttcactggtggatcattacatatcattaattgtaggttactatgatctgagtgtgttcttgcaaaatttatacgttgaaatcctcaccctcaaggtgatgacattaggaagtggggcctttggaaggtaattaggtcataaggccaaagccatccagaatgagaatagtacccttacaaaagaggcccaagacagttcccttggacctgctgccttgtgaggttacagtgagaagacaggaaatgagctttcaccagacaccaaacctgccagtgccttgatcttgaacttcccagcctccagaacggtgagaaataaaggtctgttgtttataaggcatccagtctatggtattttgttatagcaataaaacttgactaaaaatagttttcgtattgcaggtaggctctcaggagaataaatttataatctactgcccagaggatagaaacttaagagccaagaaggtgaagagggactgctggtctcaccattaaatatgttgactttaacttaatcctgtattttcagtatggtggctctctcttccatcaactaatcctgttgtccaaatgccaaaagttgtttcagcctcaccagaaagcaaaccactcactcacgtctgctgggatgagagaggagtagtgtctaattaactaccctgagctggggacatgaaatgtaattgccccttttaagggattcaaaacaacccctttatttccagcccctctcgggaatatatggccttctaaaacacctagcgtcttcaatccacaagtttttctgggatcctgaaaaacaaattggcttacttgtcctaattttcatctcattgacttgatatgtctgtgcagatgtctcttcttccattttatttgtcattttatgactgtattgtttttattcccttagcgtaatctttgaacaatttgggagagagagaagataaatgtatgttttcgattgtcatttctattggaggtccatgttcacgtttgtgtcttgttctctctcctcaggtatcctcatctagcatttagtagttgcatgtgcatcgcgtcccgtggtctccagccacccctttaaggtttaaagttcttgcactgcaatgttactggggataatttcaatccattcatcaagcaagagaacagatgcaacacagttcccagcagcaaggctatgtctttattcttacacctacataggcccataagtttaggcaagccatagcgtcaggctacagcctgaagaagcactttttccccaggttttctttcacgaatgcaagcaccacagcccagcctctggttttgaatactgagtttgtctccagttccacaccttgcttgaagcaattttaatcccaactatcccgcagcatccaaattcctggcttccactgttgttttgtggttcagtgtcaagtctgtcagggacttccgccccattctctgctttacatttctgtaaatatatttctgtaaatacacatcatgatttgatatgtatttgattatcttgtcatcaacatatatttctgtaaatacagttctgtaaatatatccttttttattttctattttttcattgctgtattttgggagcagatgaggataacacttggattagaaatctctaatcattttgcattggtttttataataggtaccagcataacgtatatttttccataaggcatatacccaatagagggaccactattttatagccttaagtggaagctctgttatgagacatatgtgtctcaacccagccggttctatacagtttacaagaccaggtagatcatcatgctccccagagagacccaagataagatgattagggttatttttctagcacataaaatagacttccttttctgacatggaggcctgaatcctaaccaaatttccttggtaactgcaacaagaactgtctacatattgttccaattccaccttcagtccttcagggaacagtgtctggtgtgtggcctatgtaacattacacagcactctggagattccacagatctgcaggcctagtaacaaaaatagaagttcaactaaccaatcaaccaacaaggatcactctgggccacctaagtcctgttacagaagacaaagtaatgatcagtctcatcactcccctcctttaaacttcagtgtccttggtactaataacactcatgttggaaataaagccaatagaatcattctgcatatgctttattacctgaaataccacctttaacattaccctctgatgactttttaacagttaacttcaatgtctagcacgttgctatatgtctattttttttcaataatggaagcactagaagggaaatggcattattatgtacacgaaagatttatatacaaagagtatgtaacttattttatttgttaatacttttgctacttttccaaataagaaaaggtaaaacatgcaccctataaaatcacatggaacattttggttaaaaatgcttctgtgtgttctaaaacattataatacttcatttcttgagggttggattctcttatcatcaataataatatcatgtagttagaacgcattggcatagatatataatcattttatgggtccgtgaaatgaggatagaattgggaggtcacaatttttgtagcaatatttttgttattgttagtttttttgtggtactgaaaagaaagcaagcgaagaaagcaaggaaagcaaaggaacgcaaaggaaaaggaaaaggaaaaggaacagaaggaaaggaaaggaagaaggaaggaaggaaggaagaaacaaaagaaaggaaaggaaagcagaagtaaagaaaagaaagaaaaaaagaaaaaccaagcaagcaggcagacaggcagacaggcaggcaagcaagctagttaagtaagattttagataaggaaataaataggaataaataggagatgaaattatatgatcctagggctagggtaaagaaaagagcaaaaaggccataaaatctttctgtagcgtaataataaaaataacttcaaaagtgcttgggttgatgatagcctgacaaggattagcttgggtacataccaattaaagacagctggtctagaagctggtttcacatgatgctacagtaaactggtaaagcaagtattaaaacctaaggaacaaactctcctgtgatatttactggctcaacatcttaaggataaaagacaattatatgatgttaattaagacagtgctatgctggtaaatgtctaacaatcagatcccctgagaggaaggacatatttgaatattcccagtatgtttaattttaagctatcattataatgtcaccaaacatgaagttagcactacaccattatacagtcattccattatacaggtaacaaacccgtagataatagtgaaatataataaaagaattaggtagtgatgacttttgtgcatctagtacatttgtgaacaatatatttcatttaatgtaagttaccataatttaatttttgataatggttgtgtttaacagatctcaaaattcttgaaaatttaacaagtatttccagcacatcgactcaagttaaacattagtttatcacaatgtacacaaaagaagaggttcttatcagtacctatcccatacatcattaatttttcctattcttctcaggtattagtttatataaaattttgttttctctttgaaaataaggagtcttgcatttgtatgaaaattctaacaagaggaacgaacttttttttttttattatactttaagttttagggtacatgtgcacattgtgtaggttagttacatatgtatacatgtgccatgctggtgcgctgcacccactaactcgtcatctagcattaggtatatctcccaatgctatccctcccccctccccccaccccaccacagtccccagagtgtgatattccccttcctgtgtccatgtgatctcattgttcaattcccaccccacctatgagtgagaatatgcagtgtttggttttttgttcttgcgatagtttactgagaatgacggtttccagtttcatccatgtccctacaaaggacatgaactcatcattttttctggctgcatagtattccatggtgtatatgtgccacattttcttaatccagtctatcattgttggacatttgggttggttccaagtctttgttattgtgaatagtgctgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgacttttgaatgattgccattctaactggtgtgagatgatatctcatagtggttttgatttgcattactctgatggccagtgatggtgaggattttttcatgtgttttttggctgcataaatgtcttcttttgagaagtgtctgttcatgtccttcgctcactttttgatggggttgtttgtttttttcttgtaaatttgtttgagttcattgtagattctggatattagccctttgtcagatgagtaggttgcgaaaattttctcccatgttgtaggttccctgttcactctgatggtagtttcttttgctgtgcagaagctctttagtttaattagatcccatttgtcaattttggcttttgttgccattgcttttggtgttttggacatgaagtccttgcccatgcctatgtcctgaatggtaatgcctaggttttcttctagggtttttatggttttaggtctaatgtttaaatctttaatccatcttgaattgatttttgtataaggtgtaaggaagggatccagtttcagctttctacatatggctagccagtcttcccagcaccatttattaaatagggaatcctttccccattgcttgttttcctcaggtttgtcaaagatcagatagttgtaggtatgtggcgttatttctgagggctctgttctgttccattgatctatatctctgttttggtaccagtaccatgctgttttggttactgtagccttgtagtatagtttgaagtcagctagtgtgatgcctccagctttgttcttttggcttaggattgacttggcgatgcgggctcttttttggttccatatgaactttaaagtagttttttccaattctgtgaagaaaggcattggtagcttgatggggatggcattgaatctgtaaatcaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttctgtacattgattttgtatcctgagactttgctgaagttgcttatcagcttaaggagattttgggctgagacgatggggttttctagataaacaatcatgtcgtctgcaaacagggacaatttgacttcctcttttcctaactgaataccttttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgagatatgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccaaggatgaagcccacttgatcatggtggataagctttttgatgtgctgctggattcggtatgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagctcctgttattggtctattcagagattcaacttcttcctggtttagtcttgggagagtgtatgtgtcgaggaatgtatccatttcttctagattttctagtttatttgtgtagaggtgtttgtagtattctctgacggtagtttgtatttctgtgggatcggtggtgatatcacttctgttaactctacaagtcaaacctgaaatcatggctcacaaccagcaccacctaatgtcaggcattggaattgcatatgtagagcccagaattggttttccacgtacttcagagtcaaatgtgaagctaaatgcacacacacccacacaccctacagatatggccaggacccaccccagaccaaataaccaggatatctaatttatttttatagccatgtaggtaatttaaattcagttgttgaaccaagtttgaaaacgattgtcaaagaaagaggtattactgtaattctgattttaaaattttacatcatgaaaatcttcaaagacatatataagtaaagagaacagtatattatggacccccatgcacctgtcaccaccttgagcaattatcaacatttgcgaatcttgtttaatcttcctccattgctctttatattaaaaataatttccttggaagtttgtcaaaacaaaacccacgaatcacattacttcacctgaaaatactttggcatgtatctagaatttctctttaaatagcacaatctattatagtagcaataaatgccaaaaatcgttaagtatttcttttaaatattgagccagatatgatggtagttgctgcagatgtgaaaaaccttagtgacaattattttttaattttatcttacataaagccagttagattcagagacacatttggtcaaactttgtccttgacatataaatagtgtttctttcctaaactttccattatctggttaatttctcctaaactttccattatctggataatttctcctcattttttagaactcaattcaaggatcatctcacccggatccttccagactgagacccccaaactgtgttagacagtcctgctttggtatatgcctagctcccaaggcagacatgaactgaggactcgtcactgtgcattaaaactgtgagttcataattcctttctgtatatataaatacagaaatcagggtttatatgttattcagttttatatttctagccctcagaatcatagtagggtcacactaatctttgttgaatgaataatgagtctatgaatgaccagtttgacagagtttaagtgtggatgtcaaggataaatgaagaaattagccaagtctgctaatatgaagatgtatatttaaatgagaagattttataatcttacactttcataattatgaccacattgatttgaaggttttatgaagagaaagaggttatactaattatttgagctgtttcttttcataagtgattgtggtcagccaaaattaaacaatgatgctacgaagaaagattaaggaaggatattatcaaacagccccaaacctgccagtccttcatggtttcactgtaaatgctcaggtacagccaatacttatatatgaattttaataatcaatatttaatgaaaatgccgttcttaaatttatctcatatttgtggtagaggagatttacaaaaaaggcattgttaacattagttaaaacacttatacaactgttgttaaataaaacttctgaagtcatatagttatttatttacttgtataaaccatcttatcatattcttttttggagctgtttacatatcttttaatctctgaactaagaaattaaaattgtatttgacaacaattagtgactcaaattataattaaaatatatgttgttacacacctcgacaagcaagcactcagaaacccactttatattctgtttctattaggatactaattatggcactattccaaaaaaaaaaacaaagaaacaaagtaattaactcattgcaaacacaatactattaattttaactccttggttctcaataaaatttgagctagtaaccacgtaattaattattaattgctcagtgcactccactatgccaagttaattatcaagaataacttggtgtgacttttattatgaatggataattacaaccttgtttttctagaattatcaggattttaaacatgaaaataataatgaaggtaaagatataggcattgctcttaaatatgctgatatgctaatcattatgaaataataggatgttcatttttataatagtatcattcttatatagggaccaagacaggatagaaaagtacttagaaagtactaagctaaacaaataagttaacaaaggatgaatcttttatatataatgatatatattcgtgaagtgaaaggccaattcttagttagacattagttttattccagcctaggagaattctcattcattcccatgctctaccataagaattacaaatatctaagtacatgtatgtataaacatttgctgaacctattttggttatgcattaaataatctttaaatgtgaacacaacagtaaaacatatgttttgttttcatcaattttatttcagttactgagtcagaactgcccaactgaataaagttttgtaaacatatagctttatagttccttaaatctaaatctactctaattttcaaagcacaaaaaaatacaaagcttatcaaatatcctactaaaatgttcctttgaatctatggtctcccatttgtttggtgatcaagagctactgttcataatttcaaagaatcttgaaataacaaagtggaaaagtgcttgaggaagagaccaggatacactgacaagtagctcagagtgctaatggcaagggtcagaatcatagctgtattatgcctattttacttatgagaaaattgaggttcagctaaaacttgccaaaaattcacacaatcagagattgatggagccacgattcaaactcaggtcaatctaattccaaagccaagctcttaactgtgtctgagactcacttatccctggaaaagctacaaatctggctttctcctgtcaatattcgacacaaaatgaaggcaacctttatacaagtggcttttatttctttctattcttgtccttggttcaaggatcgaacactcaaggagacctaaatattttggaataggagccaggataacctgtcctcagagatgcttccttggctgcatcacctagccataagtactccctttttgcaggaaaacttgcaaccctagaaccataccataccaaacttccttcattttctgattaaaactattttgtacataatgtcccactttttttgcatcacaaacgccttgaaccattaagtacacaagtatattcctgggaagatgaattaaggtcttcatcttgttcttagaaagtatgtgtttattttctgatagcagaaataataatactttatagttttatagaatcttctcaatggaggatttttaggagcttcacatgtatattactgattgcggagtgtttttattgcatatatctcagtgggagtattggaaatgggtttttcaacatttaaatatatgccatttaaaaaatcccacttcctcttctgcttacaatctattctctgtcttcaaagtgataatattcacttaatgtcgactttggaaacacataataaaaatggtaaatgtggattttcctcactctctttttagctaatattgtggcaaatgtcttcttccctttgtaagcaatattttctctcttttctattaagctttatttgcctagtttagcaggttttatttttctcctgcttatcgtattcctatccatgcgggtcaaaaggaaattaatgagctcttgtttcctctgacacaaaacatttttcttggtacacagttctgcctccccagtgttttcactctggacatgacggaaacagtgaaaagcaataggagatgggagaaggcattgcattcgcaatcaacatatggtcagccacttccaatgagttttcagcactgatgaacactatcactgctgtcttaagcttatgctggtgtccattactgtccactggctgctttgtgaaactacatctcctggctttcttcatacctcgatggtttttgtgctccttttcagggttattccttacccagtcactaaatgcattaaaagtacctcataaaacaggatgacttcatgtcctttgcagggacatggatgaagctggaaaccatcattcttagcaaactaacacaggaacagaaaatgaaacactgcatggactcactcgtaagtgggagtggaacagtgagaacacatggacacagggaggggaacaacacacactggtgcctgttgggggtggggggctagggtagggatagcattaggagaaatacctaatgtagatgacgggttgatgggtgcagcaaaccaccatagcacgtgtatacctatgtaacaaacctgcacgttctgcacctgtatcccagaacgtaaagtataataataattaaaaaaaaaagttcctcaaagatttgtcctgatcaatcttctacctacagtctctctttaggttattgcacccactcacataactttaaatattatttacatgcctaggtatcccacgtatgtatcttggtcacagatatttcatccacgtttcatgtagatgtttcagatgtatctcaaattgaatataaatctagaaaggtctccacctccaaatctgccccttcttttctgttctccagctcaatattatctaatatgctcagggatcatccctgacacttcactgtctttcaactccactttcaaatctgtcaaaagttgctactaatagctccattaacataagtatcaaagacatgtttatttccacttccattgccatctcaaggcttggtctatgctttggtattctaagtggccattctgttttcagggaggttccctaaagtacattgttttcagcaaaaacaatgattatgtcactaccttgctgggtgaggtggctcatatctgtaatcccaccattttaagaggatgaggcgggaggattgcttgggcccagtaatccaagatcagccttagaaacttagaaacgtaacaagaccctgtctcttcaaaataattgtttaaagttagccaggcatagtggcaaatgcctgtagtagtcccagctacccaggaagctgaggtaggagggtgatatgggaggattgcttgagcccaaggagttcaaggctgcagtgagccgtgatcatgtcactgcactccagcctgggcaacagagtgagattgtgtcttgaaataaataaataagtaaaacaaaatttaagaatcaaaaaataaacttgtaatggttttccgttgcacttagataaaatctatacttatttttgtggcctacaatgacttgtacaacgtaaaacttgccacgctctccctctctcaccataccccatacacaagggctttcttttagaatttcgaacattccaagatctctaccaacatctcaagactttgttcatgtgactccctacactctttactgagttgcaggtctctgcttcaatacttttcctcacagataattactctcagtctctagactgcagcatttctttttgttagaatatctcatagctccttatacttttcattcatagcacctactgcggcttgtaaatatacactcatgtatatgattattgccttaaaatacattttcccccactaaacattcagctccaaaaaggcagaaacaatgtgttctttgttaatttctgtagagtttttgagacaggatcagaattactatatgttgaataaatgaatacagaaataaaaataaagattatgatgcctttgctcactgatatatagtgccatatatatatatatataaacatatataaataaatatataaatatgtgtatatataaatatatataaatacaaatatataaatatatatatataaatatataaatatatatataaatatatataaatatataaatatatataaatatataaatatatatataaatatatataaatatataaatatatataaatatatataaatatatataaatatatatataaatatatataagtatataaatatatataaatatatataaatatataaatatatataaatatataaatatataaaaatatatataaatatatataaatatatacataaatatatatagatatataaatatatatatacataaatatatataaatatatatatgtttgtgtgtgtatatatatttatattcaacggtaaatggtttataaaactttcccgatcgattaagtattggtatggagtcagagaagtgagggaaaacagttttatctaccatctttgagatatcatggtgagatttaaggatacagagattaaatatattgtccaggtctttaagaacctcatagacagagtttatgtgtgactctaaaaaatagatgaagataagaagataagtatttaaatgaaaaaattgaggcggccaagggtttggggagcttatgactgtctttaaccctatcgacactaagagaatagaagttgcttactaactggtcacttagctgactgaaacagcttctctctttgtaggaagtttaagttccacaattactcggtgccaaaaaatactgtgtgctattcaaatttctggaggatgaaaagctacatagggcatatggcagaacgatgtaaagtgcagaatatgcttagctgaagattgtcccaaagctcttgggagatgtttatttggtgacaatcgcattcactttatattgtcagccctttgttagatcatccttactcatcagggtctgatccttgctttaattgtacttagggaattatttatctctatatcaatctaaaattgatttaatcttttttttttttttttgagatgtagtctcgctctgtcacccaggctggagtgcagtggcgtgatcttggctcactgcaacctccgcctgctgggttcaggagattcttctgcctcagcctcccaagtagctgggactataggcgtgcaccaccaagcccggctaatttttgtatttttagtagagacagggtttcaccatattggctaggctgttttcgaactcctgacctcataatctgcccgtctcagcctcccaaagtgctgcgattacaggcgtgagccaccacgcctggtcaattgattttgtcttacacaattttctcttctgggcatcactatcgttcatcctcatcttctttttcctctatgtttaaaaatgaaaactcttctgcaaaagagtttattaaagcttatttattctttgtttgtttttgagacagagtcttgctctgttgcccaggctggagggcagtggcatgatcttagctcactgcaacctccgcctcctgggttccagtgattctcctgcctcagcctcccaagtagctgggattacaagcatgcgccaacacgcctggccaatttttgtatttttagcagagatggggtttcaccatgttggctgggctggactctaactcctggcctcaagtgatctgcccacctcggcctctcaaattgctgggattacaggcgagagccaccacacctggcctattcttttttgttttatataagaagtgtagcatataataatgtgtggtggtgtggtagagataagaagtggtttttgaaaaggaaaatgatcacatatacattattcacttgctagttatgcttactgggtatctacttggccaaacaatgaatcaagtaacgaaaatgtaactgtcattctaaagaagttcacagtgtgtatgttgtttgtacatgtacagagtcatagaggtgagagagatggagaaaagtgatttaataagtaagtacacaaataacaaataacatgattcataatgtgaagggtgtttatatccacaatggaaatggaaattggtgagtaccaatttttattagatgttacccaccattgcattacatgcaattgttccatcttaaccatatcagctgcactaaacatggctcattactgctcactaataggaatacagatttatatcagcaatttgggcacatgggcttgtcttttttaactgtgggaaaatatacaaaatatttcaaccattgtaagtgtatacagttcagtggcattagatacattcacatggatatgtaaacatcaccaccatctatctccaaaactcttcatctttctaaactgaaactctataccaatgacacaagaactgctcatttcccctacccctccctggtccctggcaaccatgcaactatttgtctaagaatttaactactctaggtggaatatctccaaagttcatccctattttaggatgtgacagaatttcattcctttttaaagcagaatactgttctgctgtatggatacaccacgttttgtttctccattcttggtcagtgtacacagtgtacatttgtttctaccttttctctacagtaaaatatgctgctatgaacttgggtgtacaaatatctgtgtgaatacctgttttcaattattttgggtatatacccagaagtggaattattggatcatataatagttctttgttaaattttattttaagaactagtcttgtagtttaaaaataaagttttattggaatataatcacactcattcatttacatattgtctatggttgcttttgcaaaaaaaaaaaaaaatggcagagtttaatagttgtgagatagaccatatggcccgcaaagcctataatatttactatcttgttccttacagaataagtttgctaacttctgtcttacaaaattgcagtagcaattccttggtttcacatgaaacatatgtcttcaaacagttaaaagacctttcatgttgggaaatagaaacaggataattttattctcggcctacatatgagaaaacaaggaaagtgctgaatgccacatggaagttgcaatctcaaaggaagttaatccaatattaatatccagacctcattgttgcagctaaatctatctcatcacaaatcacagagttattttacttctttatatgctatatagaaaactcagatatactttccctatatcaatgcgatgtttcatgctttcttcttttattgaagatggggtgggaatactgcatcaagtgagagacttgagtctgggagaggctgagttgtataactgtgaaatcatttgtcctccaaaagcttggatttaaaatataacagattcacgtactatgtatgactgaaaacatacttgcctggaatgttaaagatcagggtaattttctgtctcgttaatctaatattgacagtggagtataaaagtctctcactattactgtgtaggagtgtaagtctctttgtaggtctctaggaacttgctttacgaatctgggtgctcctgtattgggtgcatatatatttagaatagttagttcttcttgttgcgttgctccctttaccattatgtaatgtaatacccttctttgtctttcttgatctttgttggtttaaagtctgttttatcagagactaggattgtaacccctgtttttttttttattttttttaattttttatttttttgctttccatttgcttggaaaatattccgccatccctttgctttgagcctatgtgtgtgtttgcatgtgagatgggtctcctgaatacaccacactgatggtcctgactctttatccaatttgccagtctgtgtcttttaattggggcatttagcccatttacatttaaagttaatattgtcatgtgtgaatgtgatcctgtaattatgatgttggttagttattttgcctgttagttgaggcagtttcttcatagggtcgatggtctttacaatttggtatgtttctctcagtggctggtaccggtttttcctttccatgtttagtgattccttcaggagctcttgtaagccaggcctggtggtgacaaaatcactcagcatttgcttgtctgtaaaggattttatttctcctttgcttatgaaacttagtttggctggatatgaaattctgggttgaaaattcccttattgaagagtgttgaatattggcacccactctcttctagcttgtagggtttctgcagagtgatccactgttagtctgatgggcttccctttgtgggtaacccagcctttctctctggctgcccctaacattacgagcaacttcagccaagtctcagaatacaaaatcaaagtgaaaagatcacaagcattcctatacaccaagaatagacaaacagagagccaaatcgtgggtgaactcctattcacaattgctacaaagagaataaagtgcctaggaatacaacttacaagggatgtgaaggacctcttcaaggagaactacaaaccactgttcaagaaaatacgaaaggacgcaaacaaatggaaaaaacatttcatgctcgtggttaggaagaatcagtggagtgaaaatggccatactgtccaaattaatttacagattcaatgctatccccaacaggctaccactgactttctttacagaattaggaaaaattactttacatttcagatggaaccaaaaaagagcttgtatagccaagacaatcctaagtaaaatgaacaaagctggaggcatcatgctacctgacttcaaactatactacaaggctacagtaagcaaaacagactggtactggtagcaaaacagatatatagaccaatggaacagaacagaggccagaaaaataatgccacacatctacaaccatctgatctttgacaaacctgacaaaaacaagcaacggggaaaggattccctatttaataaatggtgttgggaaaactggctagtcatatgcagaaaacggaaactggaccccttccttaccccttatacaaaaatcaactcaagatgcattaaagacttaaacctaaaaccgaaaaccatcaaaaccctagaagaaaacctaggcaataccattcaggacacaagtacggggaaagactgcatgactaaaacaccaaaagcaacagcaacaaaagccaaaattgacaaatgggatctaatgaaactaaagagcttctacactgcaaaagaaactatcatgagagtgaacaggcaaactacagattgggagaaaatttttgcaatctatacatctgacaaagggctaatacccggaatctataaggaacttaaacaaatttacaagaaaaaaaaaaacccatcagaaagtgggctaaggatatgaacagacacttctcaaaacaagacatttatgcagccagcaaacatatcaaaaaaagctcattatcactggtcattagaggaatgcaaatcaaaaccacaatgagataccatctcacaccagttagaatggcgaacattcaaaagtcaggcaacaacagatgctggagaggatgtggagaaaaaggaacgcttttacactgttggtgggactgtaaactagttcaaccattgtggaagacagtgtggcgattcctcaaggatacagaaccagaaataccatttgacccagcaatcccattactgcatatatacccaaagtattataaatcattctcctataaagacacatgcacacgtatgtttattgcagcactatttacaatagcaaagacttggaaccaacccaaatgcccatcaatgatagactggataaagaaaattggcacatatacaccatggaatactatgcagccataaaaaagaatgagttcatgtcctttgcacggacatggatgaagctggaaaccatcattctcagcaaactaacacaggaacagaaaaccaaacaccacatattctcacccataagtgggagttgaacgatgagaacacatagacacagggcggggaacatcacacaccggggcctctcaggggatggggggttaggggagggatagcattaggagaaatacctaatgtagatgatgggttgatgtgtgcagcaaaccaccatggaacgtgtacacctatgcaacaaacctgcccgttctgcacgtgtgtcccagaacttaaagtataataatgaaaaaaagatcagggtaaaatatattttgtcattgttttgaacatagccataggtaggatcataaaatagcacaacttaaatagaaaaataaatgattcagaatcaggtctcaggtacaaacagccaaaataattcaatgaaattatttctctatactacaaattgtggactcacatggcatcatatctgatataaataatagtttattttaaatgaatatagacaggagtggctggaaactaaaagcatgtatttcttctccataagatgaaagaggatttaggatacacttaagataacatactaaatcttgttttgccagtgtagcttctgcttggcatttaaatatctgttacttaatagaaacattcaattttggaccctaaaatatcacacaatattattcattaaaattatacctactcaaatctgtctagccatatcatatagcgactgatatttttagatcaaacccacaagtgtgaaatatttttcattttaaagactcttttacatttaatatgtattcatgctaactttttaaatttaaagcaccttctatgaaatgtattttaatacaaataccctatattgtataatttacttcaacgttgtaaattttccacgacgatgtgtatcattcacaaataatatgaaatataaaaattcacttaaacatatataaaattattggtatatttactttgtactaaatgtaatgggatttgatattattatattaaatttatattcatgatgaatataagtaaacattgagtaagaaatgttttaagaaatttgctatctgcatgaatgactattcaatacatttttattgaacatccatcgagttcgttgcgatgaatacagttttagaaaaaatactaatactctggcttcgaagactgctatgtattgaaggtctacaatgctttgaatgctgtaggaagacaagataaattaggacttttgatcaccgtcccataaaagcttataatttgtctaataaggaatagccaacaattattacaataggagacagtaaaaataagtagaatgcaatgttccagatgttcagaggagttggagatcatctccttatgggttggtcaagagagccttaatggaaaatgtagcatctgagcagggcatggaaggatcatttagtggatattcctctgtcccaaaattttttgtctgtccaatatcccttctgtggtgaagaaaattagtactctttggatatcttggtattgatttcattatgtttctcatgttcccttgaggtttcgtgagtgcaattgtgattgaatcctggaaagtgggaaagtgtaggaagtgatgcatcacttcttgcctgaggtacttgatagttagtgtcaatttctcagctctcctttgtcaatacctctgaagtttcaatgttgacatggcagagccacaagatgaaagcaatttaggtccctgagtcactgtgaaggaatgctacctgatttatatcagactttatatgagcaataaataagcattcattaggccactttgatttcagggttagtttttttgtggcatctaacattaattgttctgaataagtatctccactctttggtgaatggtaccctgcttttccttggatgaaattactcttccctcattctgcatgatcttagggggacctataatcatagtgctctgtaaactctataaactggtgggacaagttcctaatttatgccaattacatttagaaatttgaatctagaattgagaaaggtagagtcagtacaatttgaagctgaagcattttaatgacagcatccaaaaagtaacttccctggagttcctgactctcagtgctgccctccctctgccacagttgccttcttttccttcatttccaagaactatacattatccctccagtaagtttcatttcacttcagttaaatggagatggcttctgcttcttcgaatcaaagcttcctaatgtttacaggtggtgaggacttttatatataaaattacactccaaagaagtatggaataagggtattttagagaaaataagtacattttgctgtagagttgcatagagatacaagtgacagaagctaagttagggtttataagtgccagactatgaattctggatgttagcctctggcctaggaggttagaaaatcaaatgccttcaggggacacgtgggacacataaaattgtaaagccttagaaagtatagcaataagtgctaaactgatggtgttgatcagtccagtctctgcccggtttcattgccttttaatgttccttgcaggtcaaacaaagcagccaagcaaaacatatccttcagctctcttttctcctggggctacccgtttgaaatcaaagctatcaacagagaaacactgaaggttcctgtgctgggaaatgtgaagcaggagtgctgcttcagaaaggttaactctttcaaaagaaacagtgatttgggtggagagagatctcttacaaggtatctactgacttgcgattgatgtccaggagaatgaaaagggagggcatgaaaacataaaaagtgtacagaatccagtaaatggcaaaatattcaattaaagtgcagggaggtataaagaaaggacaacacatgttttaatctgaggacattataagaaataatggtggtatgttcttggaattgagaagcctaactaagtcacaggttataggaatcaaagtggtggtgctattgacttggtaaatttaagagaactttataaaatttgtgaattcgttatttctttatcttaaatgcaatagcactaatgcctcaaaagaacaacctacaaatgtctacccacagaagttatacaggctattttgtttcaatgaatggctggcccgagaaaatggttgcactcaagagagaatgtttgcgactgtttttggaaattcttctgtgggttgggtaataatacactcaagagacatgtttgtgatttttctgggaaattttttcgtggagtgggtaataaatagagcagaatattaggtgagaaatactcaatttcaggactagttattttaaactgttgtaaattataatattaaattataaaatttaaacattgtgaatatgttctttttctgtactcaggtattaaatcaaatatttttgggtaattagtggaaggtgagcttataaaaagattgatagcaaataaaacagtaactgcctcaactccagggttacttgatacctaagggctaatccaaacatgatagtatctttaaatacataatgtagacccataaactagtatcggaatcaaattacaatgtttttattgactttcttaatgtgtgtaatcacacggagatcatattattcacaaaatgaaagttagtagtttgtgagtgaaagaaggcagaccagaaataaggtacatacttcatgattctacttttataaaattctataaaacgcaaacttatctataatgccagtcagcatcagtggtaacctgggaatcaagggaggggcaggagagagtgattaccgaaaacagacttgtgaggatattggatatgtttattatcttgactgtgctaatagtttcactggtatttgcatatgtcaaaacttatcaaattgtactatttaaatgtgtagcttattgtatatcatttataccacaatgaaattgtttccaaaaaggactagcttggccaatacactacctaaatgcattactaggtatacaagttttacttaaaaacaatatatgtctcaataagtataaagattaccgtagcgaacactgtggtgtgccaccgagattcaccaattacaaatgaagcattcattctcccagttgctgggattgttatctactaacagatcatacctaagctcttccaagaaatttctctcagcagacaggcacttctttgaccaagatgatattgcccggaagctggtagttgggaggctcacatctaatgactaatggattagggatacaatggtccaccttccttgcttcatacggtaatactctaaatggtcatcccaaccccacatgggaccagataagatcttccatttcactgcatcatcattcaactcctctctctcctcaatcctgctgcctttactccctcccaggcatttttcttaaaagcactcactaagaaaccatctgcatggaaatctctgtcttagagtctatgtcttagaaaatccaatctaagataacaacctaatatgttgagaagttaaaatgtagaaaacagaaatacatatctgaagtaatcatttaaataacattatgaaaatgtacatcagtatttataaatagccattatatacaatgatacaattttgtttatcatttcttcaacttactgctagatttcagggaaaaatacaggatacaagtacttaaagaaagctcaagaaggagatatggctgattgcataatagaatattttgcagactgtcaactattgaggacgctggcatgtttggaagaataactgttattaaattttagaacataaaggtacaacatattgttatcaatcttaataaatccattcagcatttcagaataacatgaaaatatgccaacagaaattccattttactattgttactatcaagaacttggcaaaatttggttttttactttgtgaatgtattaaatgatacaggtaacatatatggaattaactatatgctaactgtagcaggtttcacttttcaataaacgaaatagccgtgacaattctgtctttaggatgaagagagagcattttccatgaaaatctgaattgattttcactatctaaagacatgaaacacatatgctagctctggacgacaaaagaagatgaaaatgtcctctataggaaggccatccaggatgttgaatggtaagagacaacttccatctaattatagacacattaaaacatggtccgttaactacaacccttatcctttccctttctaccaaccctcatttatccctcagccattgattttaaaaaatattttatatatttgacacccaaaggaaaaaatgtaaatgaaactcacttccaagagactactgctctcagcaaaccaaaaagagaataaaaaacaaatgtctacaaatttcttcaatgtagaaaaacaattcatagatcttaaaggcagtgatagggtttggctgtgtccccacccaaatcccgtcttgaattgcagttcccataatccccagatgtcatgggagggatccagtgggaggtaactgaatcatggggggtggtcactcccgtgctgctgttcttatgatagtgagctctcatgagagctgatggtttcataaggggcttttcctcctttgctcggcacttctccttcttgccatcatgtgacaaaggatgtgtttgcttctgcttccacagtgattgtaagtttcctgaggcctccccagccatgcaaaccagtgagtcaattaaacctcgttcctttataaattacccagtctcaggtagttctttatagcagcatgagaacagactaatacagtaaattggtaccacagagagtgggatactgctataaagaaacccaaaaatgtggaagcaactttggaactgggtaacaggcagaggttgaaacagttgggaggactcagaagaagacaggaaagtatgggaaactctggaacttcctagagaattggaggggtcagaagacaggaagatgtgggaaagtttggaacttcctagagacttgttgaatggctttgacccaaatgctgatagtgatatggacaataaagtccagactgaggtggtctcagagggagatgagaaacttcttggtaactgtagtaaaggtcacttttgctacgctttagcaaagagactggtggctttttgcccctgtccgagagatctgtggaattttgaacatgagagagatgatttagggcatctggtggaaggaatttctaaacagcaaagtgttcaagatttgacttgggtgctgttaaaagcattcagttttatgtatccacaaagatatggtttggaattggaaattatgtttaaaagggaagcagagcataaaagttcagaaaatttgcagcctgaagatgcaatagaaaagaaaaactcattttctgaggagaaattcaatctgactacagaaatttgcatatgtaacgaggagccaaatgttaatcaccaaggcaatgggaaaattgtctccaggaaatgccagaagttttcatggcagcccctcccatcataggaccagaggcctaggaaggcaaaatggtttcctgggccgggcccagagcccccctgctatgtgcagcctagggactaggtgccctgcatcccagccactccagccatggctaaaaggagccaagatagagctcagcccatggctacagagggtgcaagccccaagatttggcagcttccatgtggtgttgagcctgtgggtacacagaagtcaagaactgagctttgggaacttctacctagatttcagaggatatatggaaatgtctagatatccaggcagaagtttgctgcagagatggggccctcagagagaacctctactaggtcagtgcagaagagaaatgtggggttggagcccccacatagagtccccactggggcactgcctagtagagctgtgagaagagggcttgatccaccgtgtgcatggaacagccacagacactcaatgctagcctgtgaaagcagccaggaagggggctgtaccctgcaacgccaaaggagtggagctacccaaggctgtgggagcccaccttgcatcagcgtgacctggatgtgagacacagagtcaaaggagattatcttggagctttaagatttaattactgcctcattggatttgacatgcatggagcctggagcccctttgtttgggccaatttctcccatctggaatgggtgtatttaaccaatgctggtacctccattgtacctagaaagtaactaacttgcttttgattttatggctcctaggcagaagtgacttgccttgtctcagatgagactttggacttggactcctgggttaatgctagagtgagttaagactttgagtgactgttgggaaggcattattgtgttttgaaatgtgaagacgtgccatttgggaggggccagggatgaaatgatatggtttggctatgtccccacccaaatctcattctgaattgtagttcctgtaatccccatgtgtcatgtgagggacccagttggaggtaattgaattacaggggcggttatccccatggtgctgttcttgtgatagtgagttctcatgagatccaatggttttataaggggcttttccccctttgctcagcacttctcctttctgccaccatatgaagaaggatgtgattgcttccccttctggcatggttgtaagttttccctgaggcctccccagccatgtggaactgtgagtcaattaaacctctgtcctttataaattattcagtcttgggcagttctttagagcagcatgagaacagactaatacagactgtatgatcaatatattttactttctgagtttacttattaatgctaaactgtatttttacctttttacttttgaacgccattgtcatattaataagagaatttttttgaccaaagcattttaagttctgtacacttgcagtatttgatctacagatttacacatcatggacagaaatgttatgaaaatcatttacagaattatttaatggaaaacgtttcatatttaatatattttcatatgttgtacatgtaagaaatctgattttatggccattgataagagcgataatggcagccttcatataagatacatttctgtctttttatttttgattatacctgcaagaagacacatggtcctatgcagccaataaatagttgtataataataaagttatgataataaatgtttatacctttcatgttttacatacaccaccaaatgcaaaggaactatgaagcagtttgcactgagaccagttaaaacctaaattctcccctttagctatgcggtgatctatttcctgctacatacaaaatcctgaaaaaatggggctggaagtaattccagtgcttttaaacccaatctacaatttaatttcctttgtgacctttgaaacatcactgttatagaagttccaccattcctaatgccccagatttgccactgttgtttccttattaagaagcaaaacaaagtaaaacaaaaaccttcacataattttgagttctctttcttctcagtaagggaaggattttcacttaacttcacttatctcatttttctgtgttcttcaaccttaaactacatccagccttgttcatgtctctcttaaactttcttctttatacatttcaaaagctttgctctttttctgtcatctaattgggctagatctctattcatattactctttatgttacaacctattaaccaaaatattttcatgtggcaaagaattctgatcatgaggcaaaatgaactaatgagaaaaatttgtcttcatttctagtgaaaactaatttattcttgctttctctagggatatttcaagaattgtacttttggtcttttaggactttgaaaatgttggaattggtagtgaatttctaaccaaaactgtgcataaagtcagctgcttcaaagcaagtcatagaagcctccagcaattctgtgaccaaagaaaagtaaccctaatattaacctttcctttgactttaaagacaataatttgaataatttccaggagacttgaaaaaatcttcacacaaaaataaagttttgttaaatcaatactttgagaaatacccccaaattatttctatattggtgatagtaaaagacaaattcaagtattttatgtcgttcaagaaattggcttgtgtaggattgtgcacgtgacctttaatttccacttctaattttgtcactaactgttatgaatcacacttaaaaaacaaaccatggctatgatctttttaaagctgtaaagcaagactcaataattcacagagctaaccaaaggtgagtacataggaatatcaaaggtatacattagcaaaagattaaacaagtaagtcaataaggaagaaatagaaagacacagccacacaagcctcagaatacaaaagctgatggtgaatcaggatccagaggaatgcaggagtcagaaaagtaacacaaatacgcagaagagtgaccagctggatagggaagtgcagtggcccttgctagggtaataatgcccctccctcacattgccacagatccaggtggagctcacccattatcttgggcctggacactccagggtactctggttgatgtcctacagccggaaactgcatgtcttagcctaaagtctatctttgacgcagaaaaagtagctacaaccacatgcaaaaacaggttggaagtagttgcaagaggaaattaataccctgacaccctgagcggccctttaaaagtgactaacaagagttgaaatataaacacctcagctcctgcaccttgtctaagataactctgagacaagtgttttatgccttcccagactttctccagggaattaagccctagttctcacagtggtgtttggcttgataacatactctttacaggttgctttctcttaactttctcacaactccaacatcctaccacagcttcctagaatcactgcccaaagaaactatttgaactcacatccttgtctcaggatttgcttatgtaagaacccaaactgagacactcataatgcaagaatttatattattaataccagaatcaatccttaagcatggctagtttgacactctacatagaggtaaggaaaagcacttaactggagcagaaaattcactcattcttttgaaaaatgaataaggtactcttttttgtaatagagagtgagtgtaatgggatacagacatacctaatagtagtgttacagtagatagctagtcagatatgagcagggtaggagaccccccacccccgccaccccaaccaggaatgtcaggcaaccatcaagtgatggtcagtcaggtggttattaaactgtgtctttaaaataataattggtcacagccaataccagggaaaggcagtctcccaatagataaaaacacctgaaattggtgatcagcagcttcccgataagatcgcaggagttgggcaaatgggctcccgcgtgcgcactaagaggcaaaatgtcatagtgtaactggtatacgaccttcctctggaaacacttgactggtaagggaacacctcttgaatacaactccagtaaatacaccgtgcatgctcccctcccaagtgtcagcagaccactgtgcatgcagatagccccctaccccaagggaagaattggggagaaggtatataagaccatggaagtatgccaaaatacaaaaccataaatcaaagttcaaacaggacacttaatatctcaagtcgcccacttggcccccttccagatgtactttatttcctttcatttctgctctaaagtttttaaataaactttcattcctgctctaacacttgcctcagtctcttcttctgccttatgcctccttggtcgaattctttcttctgaggaggcatgaattaaggttgctgaagacccgtatggattcactgccagtaacaggaggagagagagttattcaacgaattattatataccgactatatagtaagtgaccttactcattccggctcaccatcacaatatgagtattagggttcaaaggacaagcttttatgaaatgtaaatctcttaatataaagaattaaaataatatccaagtattagattctaaataaatacttttaaaactagttattacaagactgtatctaatcacaaacaggtttttattttgttttgtttttctcactatctcaagctgctgaaacaaatttaatggagtccttccctcatcactgaattctgtagatttttctttcagttgtaagaaaataatgctttccttttgaagatgttggcttggattagaaaaatgctttattatgagtattgcaaagctacttatttaccacagctagacagagactctttcttactttgtcatgcagctgcttgtttttaaacaaattttgccaagagacataaaccagatggtcttcttcaagggtatcctgtgagctgtgatagtcagcttatggtagttttgagcagcagacagctgggtatggaaagtcatgatgctatttggaaatccaactaccaagtgtgctgaagcacaaggagattctcaagtcagtaaataataaaattgtgacttaaagtttgtttcagtattctatttttacagggggcattaactttatgctttataatattacttttctgggtaaaataaaagtaccccaacacattgaattagaaagaaaacttgtgaaaaaatggattcagaatacctttccaagtgggatcaacaaattgtaagttgggctttctaacagagttgtctgtgttttatcaaaaatgtttaattaatactgtaataaaattctactagaatggtgtggtatttcaagttgcaagtctcagttctgttttgtagtagtgttatacacccacactcttgaaatgggttcactaactgccaagtgtatttctctatccctgatctttggatatgccacgtgacttgctttgacaattgactatggatggaagagagaacgctagttataaatctgggtcttaagaaccatcatgtgtttctgcttacccttctgagatctttagaactcagccatggaggaatgtgccccaaatatctactgccattccagcttgagccccagaatgagacacatagatcagacatgtttggtcaacctacagtcagattctgaatcagagattactcaaagtaggcctgtgaatatgaggataagtgcttattgttcttttggggtatgcttgtcacacagcattattgtggttgtagctgactaatattgattgactttggtgagggcccaataaacagctaccttgggtcactcctacattactgagagataggggaaagaaaatgagataaaaataaaagttagcatctacgtccttatcaggatgctactattttatggaaggtacccaaagaaattccagaattatatctctgatgattccaaaattccttcaaaacaaaggacacagactggaccatccttggttttcaagtactatgctataattttgaatattacagaaagacaagtgaaagaactgaagaagaaactaaaaaagcatttcaagacaaacagacaaaatttgcctttttatgaacaaagatagtttaaatttattcaaacatataaattactcaaaggctaagaattttcaaatgtgcatctaaattgtcatttcctacaagtatctagccatactaggaaactacaaagaatattttaaaacttgtatttcaggcagaaatctctcaaaaaaccacatctgtggcttgtaatgggcagttttcccttgagaacactgatattttcaagaggaatttgagactatccacggataaactaaaactaatatgaaaataattcttgtgaaaattgccttacaggcaagaatttgcaactttcatagggtaaacagatttttaaagcgttagaatttcataattgtgacaaacatcctcctagaatagaaggtgaaacaagcaagtaagcagacaagcaagcaagcaaacctttcaccagaatgttatactgactttagtgactaatggatatatttttctctatgagagactgttcatgtatctccaattccctaattagaaaaacatatatccaggtcttagattattttatatattgctgtatccacacctaaaagtcatgatttgaccttagtatagcgaaatgaaaggaaatataaggaaatttaccctgcattaataatttattgaatacactatgatggaaatggagattctgttaaccaaagagtttctcaagaaacttattcattctagaatattacagcttttgagtgagaagcttattatatacatttaagggctcatcaataaaatattaacatgtattgaacatctaacatgaaaccatactgcattccacttaggggtgacaaaaggtatatagtacagcctcttccctgtaggaaaaagtactccactgaatggtaacatgttgcaaacagctatgtaagacatataaactcatgataataacctgtaagataaataggtaaacagagagttctatgaatccagacaatggaataattgatcaagaacagagaaggattccaagaggtggtatttgcactgaatgctgaatggtgtgtaggaatttgctaaggagcaagtcaggactcctcaagcacatcagaaaatcctttaccacttggctttgctaagcatcttgtaatgaattacaatccatttctgctactgatctcgaacataaagatatcaccttcaaaaatttaaacatctttttaaagtactttggtcttgtatatgagactttaaaaagtcattatacgtatttgtgttgtttctactgatgtctatagatctggaaggaagaacataatccttgagcataagaaatcctatgtgaaatgccatggaggcaggctatgtagtggaaaagaattcataactggggtcacgatatagactctggcacatacttcatgtgtgagcttaagacaattatttattctaaaactcaaaattattcgtctctaaaattaaggttctcttgagaatgaaatgatatatgtaaggctctgaacccatgcctggcacataggtgtgcctaaaaataagctcttttatcttatgcaaggtccatcctacgtgtccagaaaaagtaatgtcttgaaatttcagtacattgtcataatatcagctttaaacttaggtccttgttttatagtggttagtcagtgaattagtaagcaaaacttgctaattaaatttaggtaacttatataacttaggatccaactttagtaaaatttaggaaagcattagccctctaagtaggagcgctatgacaaccaaattctccatttctcacatttcctaagcagtagcttaaatctaagtcagacaaaagttgatgaatgagaaattactttgagaatatggagaaacagaagagtaggtacctagggaaatgatgaaaacttctactcttatattggcagaatttagtaagccagagtaagatgcgggctgaatcagagttcataaaattaggaaagaaaaaaaaagggaagggttaactaaagacaaagttgccctttttacactcttcttagggctccttaaataaaacaaaacaaaacaaaacaaaacaggagccgggtgcagtggtgtgcctctgtaatcccatcttctcagaaggctgaggtgggaggattacttcatccagggagtttgagaccagccccagcaacactctcactcaaaaaaaaataaataagtaaaagaaaaataacgctctttttaaatatacatgttgaagactgttagttctcttccaatattctttttttttttttcatgactgaacagtttttagcagagcacatgtgaaataaacacatttcccagccccacttgcagcttagatgtggccatgtgacagacatctggccaatgaagcgtaagtggaaatataacatggcagctcccacgaaacttccctaaaagacaattggtatgcaccctttgacccttcttctggccttcttacatccttcttggaatgtggatgtcatgagagctccatcttgcaacatgtggatgaaattccaccaagtaaagataactcactcagtagaaaacagaaatgagcggggccaacatatctgccttggctgcaaacttccagggtttttcaggagaaagaaataggcttctcttttatttaagtcatttctaccttgagcttctgtaacacttagccaaagcaaattataattgataaaataaagagagtttctgggaaaagtacatttagcacagttttattttacagtaatgtcttttaaaactcatctattccaggtagagaaaaaatgcatatttagagaagggaaatttgtgaaatgacaaaaccaagaaatacacaatgaataaagtcaaatattaatatcagcctccaaaatgaggctagtcctatggacacaaaatttctttctgtattagagtctttttcctttgacaataataaaaatgtttatttagataacaagcaggcaaatacagtcccctcatatactgaagaacaagaatcatctatggtgaggatgaaaatgcttgtatacaactatcctgggaaacaaaaatgttcaattactttgagaaaaagactggggatattgatctatggctaactctgagattatgtgaattttatatctagtcaatttcttatctgaagaaagttttaaactaacctctaagtgaactgtgaagatttataagaatctgaaaatgttgaagatataaggcaaatgatcctggatgaagcggtgatcataaaaagcaaatcactctgcaactcttaagtgctttgaactataaataggaatatgcagaagataagctgatgggcagaaacaaacttctatttaatgcatttcaaaaagctctttcacttaataaatacaacaaattttcttctttaaattctttcaccacctgctcttaacaactaagaattcagaagaaattatatttaaaactaaacaaggaaatgtaaatgaaggctagtttagatatctaatttagacggtatagtgtgctgaatggttcatgttttttaaagagtttcaataagtcacaataagataagaatattattcattgataattggtttgttgtaaggagacgctttgatagtccaatatacattaaatacctcatgacaccaactatatggggttaatcttttgcagtttaaagctttgcctctggtagtaaaacttccatgtaattggcatcaatagtcaaatcacacaattcattttgggttgctgggtggaaacaaaatctcctctatttggctcacaatcactctctcagtggtgtgcaaaatgcaatgactggccagtgaatgatatttacaatagctagggattatcttagattatacagccttcagcagaaacataaacacttgaacagagcagtgtgaaatagaagatagtgtgtgggaggaggcaagctctaatctgaaatatacaagaagaaacttacatatggcaaaaaagacagtatatagaggctacgcttgatggagggagattataataaatgacagattaatgagacttgtttttctcgaagtttatgatggtttatttctggcatacatgccaagttgatgctatcaaattatagtgttcattaccattattatcatcaagtcgtattgattaccaatgtgcactctactgggcattatatatacaagcaaaattcaggtggtttctgacattcaacaaccaataaaataaatcagaccaaagattgtagacatatgtaggagagcgtatagtgcacaagatactcaaatggagaaaaacttaaaggttaaaaataaatttttaaatactttcagtgtttaggtgaactggtaagtgttttggtgtgtcagtttataagaacattgcttgctatatctaagggaactacttattcattattttcttaaaaatgaattctatccaactagttacttagtaaatcatgattttcaaagaagatcttgagggtaaaaaccagaacagaacatttccccataaaccatggtttcaacaattcaaaaaagtgagacggagtggtgcaagatgtcagaatagaagcctatataactaatctccctcactgaaacatcaaattgtaacaactatgagcagacagaaaagcactgtcaccagaaccaaaaaccaggtacggaatcatggtacctggttttaacttcatcttgctaaaagaggcattgaggaaaggcaggagacacagtcttgaatcaccaacaccacaccttcccaatcacccagcactggacgtgcagtgcagagagggaatctttgcacttttggaagggacagtacagctactgggggactttacattgaactaactgctgtgctgtcacagtagagaaaaaagccatgctggcctcagtcagtgcctgtgcacggagggaatatttgaactagccccagccagaagggaatcgcccatcccagcagtcagaactcaagtttcttggcaagcctcaccattgtgggccaaagtgctctggagtcccaggtaaacctgagaggcagtctgggacacacgaactgcaattcctagataacttctagtcatagcctgggctaagagctagaggactagggtggcatgtgacctagggagacaccagctggcatggctaagggagtgcttgcaccattcctcccccacctcaagcagtgcagcccacagtaacaaaagtgactccttacttttgcttaaggagaggagagtgaaaagtaaagaggattctgtcttgcatcttggataccagcttagtcacagtaggatagggcactggacagtgttgtgaggacccatttctaggctcagctcctggacaacactctccaatcaagagagatacagtgtctcgaccaggcatggtggctcacgcctgtaatcctagcactttgggaggccgaagtaggtggatcacttgaggtcaggagttcgagaccagcctggccaacatcatgaaaccccaactctactaaaaatacaaaaattagccacgcgtgattgtgggtgactgtaatctcagcctcttggggggctaaggcacaagaatctcttgaacccaggaggcggaggttgcagcgaactgagatcctgtcacagcactccagcctgggcaacagagtgagatgctgtctcaagaaagaaaagaaaagaaagaaagatagaaaaaaaagagagagaagaaaagaaaagaaaaatagatacagtgtctgaatggatgaaaaaataagacccaattttgtgttgacctcaagaagcactcttcacctataaagctacacacagactggaaataaagggatggaaaaagatattccatgccaatggaaacccaaacatagctggactagctctacttatatcagaccaaatcgatatcaggacaaaaactgtaagaagagacaaagaaggtcattatataatgacaaaagggtcaattcagcaacaggatataacaattatatatgcactcaacactggagtatatatatataaagcaaatatatatacaacactggagtacagatatataaagcaaatattattcgagctcaggagagagaaagacctcaatacaataacagcaggagccttcaacaaccccactttcaacattgggcagatctcccagacagaagctcaaccaaagtagtaacattggacttaatctgcactatagaataaatggatctaatatttacaggacatttaattcaatgagtgtagaatacacattcttcttctcagcacacagattattatcaaagatagaccacacagtaggtcacaaaagcagtcttaaaaattcagtaacaatgaaataatatcaagcatcttctctgaccacaatggaatgagactagaaatcaacaatgaggaattttggaagctatacaaacacatggaagttaaacaatatgctactaaatgaccactgggtctatgaagaaattaagaaggaaattgaaaaatgtcttcaaaaaatgaaagaaaaaccacataccaaaacctatgggatacagcaaaactagtactaagagagaaatttacagctgtaggtgcttctatcaaaaaagaaaaaaacttcaaataaatcacctaacaatgcaacttaaagacctagacaagcaggagcaaatcgaacccaaaattagtggaagaaagaaataataaagatcagagcagaaataaatgactttgtaataaagaaaacatacaaaaagtcaacaaaacgaaaagttggtttattgaaaaggtaaacaaaattgacaaatcttgagccagactaatgaagaaaaaagggagaagacccaaataagtaaaatcagaaatgagaaaggagatattacaattaataccagataaattcaaaggctcattagtggctactatgagcaactatatgccaacaaattgaaaaatctagaggtaatggataaattcctagacacatacaacctaccaagattaaaccataaagaaatccaaaacctgaacggaccagtaacgagtaacacaactgaagccttagtaaactctcccagtaaagaaaagcttgggacccgatggctgcactgctgaactctaccatgtgataaatattgatgcaaaattgatgcaaaaaatattgatgcaaaattgatgcagagtgaacaggcaacctacaaaatgggagaaaattttcgcaacctactcatctgacaaagggctaatatccagaatctacaatgaactcaaacaaacgtacaagaaaaaaacaaacaaccccatcaaaaagtgggtgaaggacatgaacagacacttctcaaaagaagacatttatgcagccaaaaaacacatgaaaaaatgctcaccatcactggccatcagagaactgcaaatcaaaatggattaacgactaaaatctaagacctcaaactaagaaactactacaaggaaacattggagaaactctccaggatatctgtctgggtaaaacaaatcttgagtaatatcctataagcacaggcaacaaaagcaaaaatagacaaatggatcacatcaagttaaaaagctcctccgcagtgaaacaatcaataaagtgaagagacaaccaacagaaagggagaaaatatttgcaaattacccatctcacaagggattaataaccagaatatataaggagttaaaacaactctataggaaaaagtctaataattagatcagaaaatagacaaaagattcgaataggcatttctcaaaagaagacatacaaatggcaaacaggtgtatcaaaatatgctcagcatcactaatcatcacagaaatacaaagcaaaactacaatgggatattctctcaccccaattaaaacgacatatccaaaagacaggcaattacaaatgctggagagagtgtgaagaaaaggggactcctgtacactgttggcaggaatgtaaattagtacaaccaaaatggagaatagtttggaggttcctcagaaactaaaaacagggctaccatatgatccagcaatcccactgctgggtatatatcccaaagaaagcaaatcagtatatcaaagagatatctgtactcccacgtttgttgaagcactgttcataatagccaagatttggaagcaacctgagcgtccatcaagagatgaatggacaaagaaaatgtgatacatatacgtaatagagtactattcagccataaaaagaatgagatcctttcatttgcaacatcatggatggaactggaggtcattgtgttaaatgaaataagccaggcacagaaagacaaacatcacacgttctcatttatttgtggcaggtaaaaatcaaaacaactgaacacttggagatagagggtggaaggatggttaccagaggctgtgaagggtagtgggggggttgagggggaggttgaaatggttacttggtacaaaaaatagttagaaagaatgaacaccacctactatttgctagcacaacagggtgactatagtcaaaacaatttaattgtacatttttaaacaattaaaaaaatacaattttactgtttgtaaaacaaagaataattgcttgaggggatgaacatcccattttccatgatacttgcatgcctatatcaaaacatctcatgtaccccatatatatatatgtaccccacatatatacacatatatatgtgtaacccatatatatatgtaccccacatatatatatatgtaccccacatatatatatgtaccccacatatatatataccccacatatatacactatgtatgtgtgtatatacatagtaaatctatttatatatagtatatgtttatatatagtatatatttatatatgtgtgtttatatatacagtatatatatatatatatacagtatatatatatatatatatatacacactatgtacccacaaacgttaaaaataacatttaaagataaaaaattttgaaaagtggaacataaatagaaatttgtacttctctgtctgtctactgtatcttcttctgcattgtccccatgactgaatccacgggattcctttcttccagtcagtaaaacagtggccatggaataggatatgaacaactttcttaagttcaggacttgcttgttttttaccccttacttcctaattctaccaagctcagaaaccaacagtaagtattttgtattggcacatatacctatacctgggttgtggaatgaagatccagtcttgcataaaaatcttcaaatatggtagagattaattctaagactgcaatgataatccttcgtgagttgtcagcatcctgtatgtgcttatcatgtatcttcccaactacatatggcattgtgacaaatagaagaggctgctaatgctgctatagctgaatgtctcatttaggaacaaacaattctggaaaagctcccagattatgcatctgtccctctagcttccactttaaaagataaaattctatagtgataacgtgaggattagtatactattctttccttatatgggtaatgtgaggttatttccttaccttgacatgaaagaaaattatttattgaatgtctcagtagaaagattacaactgagatagcaaattcttatcagaaactcacattaggaatgggcttgcagaattgcatgctcattccctactgtctgaatacagagacgattagggactttctcttcgaatctgatttatttggtttctactcctgttttctctcctttcgtttctttcattttctcatttttcttcatgtagcacaaatggcagccagagcctgtgagtgctttaatgctgcaggcttactgctatgagaactgaacaatggagaaatccctggggaagcagcttccaactgtcccaccctcagcatcctaatgacctgtggaactgtggttccagaatggtggtgataaatttggaaaatactttctctaaagcagtagtgcccacatatttatctgacaggctgtactgggcaattataaaatgttcaggggtccatggtgaaatgccaaaaatagaacaatgcggtatgcttttcctaaagctacaccttctttattaaaacaattatgatttatgtccctcctgtacttaaagtacatatttattatttttaaaatgtaagtataaattttagttcagtccagcattcacacagaaatgtgtacacatcacaagtgtatggttccataaacttccctaaaggaaacacatcaatgcaagcagcatccacatcaagaaacaaaacattacccagtccctagaagcctgcttcagcccttgttaatcacaactcacaaaggtaactcctatctgacctctaaactccaaagtgcctaattttttagtttcatataatagattcatacagtaagtgttctcttatttctgacttactttatacaacactgtgttcatattttatttttcaacatttcctttattttatgaaatattattaataagaacatttgattaattaaatgcccttatacttctttctctaatttttttagaggtttctttttttgctatagaaatgtaataatatagaaataaatactcttagtctcatgtctattttacatcatatctaaagctcagaaccatcttgaatttaactacttatatgggtgggtaagtcaacccaacatatctgactaagtagaattccaagaaggaaatactgattttaaaacattactttcttgatgtttgacagggaccttgttgttacacaataatgccatcttatggctgtacagcaatttgtagtctagaaactgccttcattttgatgatagcatttgaactgttctaccctcttagtctttgggaagtcattttctaaaagtgggaaacactcactaatggcttacaggatagtaaagatggtatcagaaagaaactaacgacaatagagtataacatctgacatttagtaggcccttcttaagtgttcattgaaagaagaaaagagctttgtttctctaatcccagatagatcttatgtaaattctttgtttttacatgtttcctataggtatattttataagcagttagttacccacccgaaaatcaatgaaaactgaatttagcagtaatattaatttcccaaaaagttaactagtaatcttacatataggcatatctatccatacgttcatggtgcttgtggatttactgttgactgtgttgactgttagtgaacaatcagaatgtccgtgaaaataaggcttttaatactttgatgatgtgtaacttgttgagatacatgttgaaattctatttgctgaaagacaatgtatggaagcaggtatgttagataatgaatgagcagtcataaattagtctggctttttaaatatcttcctgttctcatctaaagcgtaatgtctgttttaccttatgacatttaatagagatgactgaacgagaaatacgcagatgtactatttagtatgtgcttaggcaagtcacataacatctttgaaatatagttttctcccttataaaataatgaagcagggcaaaaccactaaggcattttctagctgtaaaacaatcctgttataaattattaactatctctaataatttgaattatggttcagcaaatattaacatctctccccccttccactgtaggaagagtctactttctcattctattgatgtcagatttggcaacgtaatttgctttggccaatcaaatgtcagtgaacttcacaggagcagaggccatgagtgttcttgggaggtttaggtttatactttggtgactggtcatgaaaacatgtcactgacccttcatcttaggtccagagcaaagacatatatagcagaccttaatccaacatgcatcatggaacctagctctactaacccacatcttgaagcagagcttcccggccaagcccagctgagtcagtcaaggtacaagtaacctaaacagccagaaatgcctgttgttttcagtcagcaagttctagggtgatttgtgtcacagcattattgcggtcatagctaatactaccatacatgtaccatttaagaaaaataccaatatagcccttcttactagctcaaatttattttgatttaacccaaattggcttactaaaaaactcagcagatttttgttgagaacaccacatgaaggctgtactgaacatttgtgtattcaggaatgcatagcttctaaatctctccaaggattcaagaatctaccattgtatgggacttagtaggacacgaggtgttgactgccactacaatgaagaacaaattcagctatttattttccctgatctctggcaataagaacctagttctgtggcctaaacctgtattgtaacagcagtcatcaatctatggcccatcagcaattccagcctgccatctgccttggtaaataaagttttatttaaacacaacatgtccatccatttatatattatacatggtttttttcaccctaaaacagcagagttgagtagttgtgacagagactacatgacctgcagggacaaaaatatcgactaactgcccctttacagaaaaaaatatccatcctctgactatcagatgcttctgccagagaccctagttgtagaatgagcgacacacagcaagaataaataatttagatactttttttttgcagtgacgatagcaagcaatgtccagtgcaatggtgctcctggtaaagcaatggactctggcatgacagcaaaataattcagatttacctcatagcttgatagtagatatattctggatgcctagcctgctcttcctttatagtttctgcccattgttaaacctagctctcaggctttcctattgattccatgaggtatctgatatccttctagtaatttatataattctacctaaagtaactagagtcactttctgttagttgtaactcagaaccttgaatggtctatagaccttgacttattccccattcttagtaagatagcttcattccattccccagggatcttgttcttgccctcttgtacagctccagtctatcaacccttattttactggctggttgtgccttttctctccaagactgtgaagctcttcaaagcagggactgagtctaattcttctctctgtagttctcagggaaatttgaaagcatgtaagaatgaattaacagatatcatgactatcagaaccataagatcaccattttcatcatcaaaattgccaaccttaactgagccattatcgtgtttaagcaacccactaagctccccacatatattgtgtcagataatcctcataacaaccctgtgacatagacactattcttatcctattttatacatcagaaatgtatggagcagaagatttaagagacttgctcaagggcacatagatagcagaaaggccagaattccaaaacgggttggaactctagagcctgtgcttataagcaattacttaaaacagtttgtatctgagattgtactaaaagtcataggaaatttaacagctcctgaccaattcctatagaatgtcaatggaagtacaatttcaacctctggataaggacagggtggatctattggggctagagaaactctatcctttgtcaaaaccagaaaagtcctcagagttggggtgagatttcagcgaccctctctgtggaatggcgttagtgtttctgtttaagtctaaggtgaaggtaaactgaaagggaaatgtccatatgacccagtgagaagggaatacctggatcatttgccaaaaattactcatgagtaaagcggaggagaaacctcaaaaagcagaaagcgttatttctactttagtgcaaaactggtaggtgtatatagaagcacagtaatcactggctatccaagaaacctcaacggtccttaggggatggtgtgggtggcctagaatgcttggagaaaacactgactataagaagacaaaccagagggggaagaacttcccaagagtggaatgaacatcccaaaagatggtaatgaaactgacatcattggagtagcccgcagagcctcataatgtctcaatgtgaaatgctgggagaaagtacaccatggtggcgatataagtttattcaaatatttttgttaatttattttagagagagtctgttactcaggctgtagtacagtggcacaatcatggctcgtggcagccttgaattcctgggctcaagtgaccctcctgcctcagcctcccaaagcacagggattacaggcatgagccaccattttataagtttaagtttgtatttgtagcatatacacagagtggctgagtttctttgcctttatcaagcctggctttggatactgtgggaccagctattttcaaggaagttgagataaatctgtttttttgttttgttttgttttgtttgagacggagccttgctctgtcacccaggctggaatgcagtggtggatttgggctcactgcagcctctgcctcctgggttcaagggattctcctgcctcagcctcccgagtagctgggactacaagcgcatgccaccacgcacaggtcatttttgtatttttaatggagacaaggtttcaccatgttggccaggctggtctcggactcctgacctcaaatgatgtgcccgccttggactcccaaagtgctgggattacagacatgagccaccgcacctgccctggaaggtgcagtgagataaatctggtagactatccaaaggggaaatattctcaggtttcggagaggaggcttgagtccagacacattgaacacccactttgtgctcagcactatatcagtcctgagcatataacacaaataaaacatagcccttttctataaggagcttgtgtgggaggcagaaaagtaaacaaattgattactatgtgttaggttttaggagcaggcacatcagatcatatattctacacggtagccaccaagtctggaaaatttacaaatgcataaatgatttattgatattaaattacattaaatgatgaaacaatatccaagtttccagatgttaggagcgactaatagttttaggatttctagaaaaagacaacatctgaagtgagacctgaagaacaggcaggtcagagggagtacaaaacacttgggcatctgcaaattgatttaatatcgctagaacataattggaggggcttgctatagggcaggcacgaagaaataagcagtgaggctgaccagataattttgcacaattaaggagtcagggtttcattctcaagggaatgagattatagtaccaaagctcttacactttagaaaaatgacggccactgaaagatcgttgagaacaaagtggagataatcacttgagacaactgagattaatgctagaaatctctctttaggtgcctgatgtagtaaaccaagaactaaaataggagtaaagatggttagaaatggacagatgtaagagataccatggaggttccctataattattagacgaatgatttgatttcctctgagaataattaagaagcctaccttgaggataaagacttctgaaatgaatcactttaagctgttagagaactttattacttttaatctaaaaatgtaaaagaaagagtaatccacttcttgtgatgtgaagctaaataatgtaattgaatttctgccaccccccaattaagtcaacagctaaatatttcaattaagataaaaagaaacatgattttaaatcaacttaacaaattccccatggcaaaaaaaaatgtgggggagggtaatgcaaagtgtaaagtgtcaccctccaaaatataaataaatgaaaatcaatttttttattgataggtagtattttaaacatgttaatctaagtatcaaactcctataaatttgtagatacagatttgactaaagataaatatgttatatcgaacaactgtttatagcacctcaatgccccaatctgatttacgattacctgaaattttagaagatataatgcttcaacataacgctaaatttaatactgaataatttctacagttcagctcatttgtctgaattgttcatcattatttgttctcattttacttaccatttttcaatgagagtgatacttctttttccctgtcttttttccatggagggtactgaaataaattctacagttccctgaaaacaaatcatttctgcaagtatcaagaaaaatatatgtgttacctacccttgtcggtccttgtacattttgttaactttttcccattggaaatcaagctgggagagagcttcctgtagcttcaccctttccacaggcgttgcactttgcaatgctgctgtcttcttgctatgaataatgtcaatccgacctgagctttgttgtagactatcttttatattctgtaatataaaaattttaaaacagtaaaaaaatgaattagctgtctatagaaagagaaaaatatatatatatatacaaatcccaaaggtagcaaatggtgttgcaattcttaattattgactttttaaagttaataaccatgaagtccagtgactttgacatgttcaaattcaataggtaaatcacagacctcatcctgagagagtggatcgctccctacatcttaaaactgccttcatttggcttctgtatcctgacctcttctgctttcctttgctggatccttctcatcctgatcttaatattagagtgctctgactcagtatttgcacttcttttcttctctgtccataatccatcccatttgttctcataattttaaatatcttatataagacaatgacacccaaatgtgtatctcaagcccggacatctcctccgaactccagtctaacaaatgctaatttctcaacacttggaggtctcacgagactttcaaacttaatatgacgcaaacaaaattctgaactgcatttcctaatccttctcatcccatagattccctcatttcagtaaatggcaattactgatttcaattgaattatagtaattcaattaacaattactcagattgacaactttggagccatccttaattttttcagtctccagtattcaaattattgggcaaatgttttggcttgactttcaggacatatgcagaatttgactgcttctcactacctttcttgctacagatctgatagaagctattattgtctctcatctgggttatagaactacctatctaaatggtcctcttgcttccgctctttcccccctactggataattctccacacaagagccgaaaagattcttttaaaacataattgggatcatatcactcctctgctcaaaatcttctggtggctcttcatcacagagttcaatcacagccaatttcaaaagcctacatgaaaaataattattcttgcaacactttatacaaataatcaggccaagtataataaagcaaatcagtcctatgatgatccatctttagtaaaaatgggagactggagagagaaaaaaattatgttttaagaactatggtacacctgttattagtctcgtcagctgtttttgagttttttcctgcaatatagactgatcctgcttattcctgtgaacctgccagtgatctctgactgcacctcagaagaaacaagaaggatgggtaatataaaaacctggatcagtattctaattctgggcatgtattggaatcagctagcagccccacatcactttggttccaacagctgcccagttcacggaaagccttctaatttagtttacttgggataattttacttattgtgttttactgttgtggaatatatttgctgttttactttttgtataggaatgcagaataagcttactcaatgttttcttagattgaaaacttactaatcttccagatatcaccatttatcagttatgaatggccctcaccaagctgatgcttgctgactgagctcctctctaccctgaatacaagagaccctaatagttaggcagaaatatcatcacccatattcagcctgaagaagttacagaagatgtattacccttctactacttaatcctaagggtaactctactacccttaggattaagggttcccttgtaaaagaaagaggggaaatatgtcagaggcgttcgaactagaacaactccatcttgaataggggctgggtaaaataaggctgagacctactgggctgcattcccaggaggttgggcattcttagtcacaggatgagataagaggccagaacaagatacgggtcacaaagaccttgctgataaagcaggttgctgtaaataagctagtcaaaacccaccaaaaccaagctggtgaaaaaagtgacctctggtccttctcactgctcattatacactaattataatgcattagcaggctaaaagacactcctagcagtgccatgacaggttacaaatgcatggcaatgtcaagaagttacccaatatggtctaaaatgggagaaaccctcagttctaggaattgctgactccttttcccagaaaactcatgaataatccaccccttgtttagcatataatcaagaaataactacaagtatcctgagtcaagcagcccatgccactgcactgcctacggagtggccattctttattcctttactttcttaataaacttgcttttactttttttaaaaaagcataatcttcactatgacctataaatctctacatgacttggttgtatactacctaccattccaagctcatctcttcccagtctcttcatagtccacaacacttcaccctcattaggtttattgcattacttgagtataacaactacattcttgcttcaagatttctgcccttgctgttctacctgccaaaaatagttttcctaacccacatttctatcagtggttcccttacttctttctcacgttaaaggggccttctctactactctattttaaatagcaccagcaatcactctttattcctggcattactcttcccttttctttatagtacttattactaacattaaaatatatatcaagtagccggtatataccactaatttgaaatctatgactacagggatgttgttatctgttgggcttccaaagctcaaacctgtgcttggcacatgatagatggcaaaagcttttttgttgaataaatgaatagatggtcccataaatttaatccataatgttttgtttatattctatttaacggaaaaatcacaaaccacaaatgggttatacgggaagaaagaaaaatctaaacatatttattctcaataaatttgctaaaaactacattctggctattcttcctagtacgaattttgttattttgatcatctaaattatacataaggtccactgagcaaaatttattgagttcttcccatgtgtaaggagcaatatagcagaaacaaaggtgggtgaaacacagtttagtttgcctttaagaagttttaagtaggttttattgtagtagtaagaaaggatatggtttgaagaattgaagaaaaaaatccaagtatagaagccttagctggatgagaagaaggaagaaatgagtgttccaagtggtaccaaacattttctagaagttagagaaaacatgtatcatatatttggtcataggctcaggaaagaattcacgaagaaggtgcaaattgcagtagacatatctgagtagtagaagtgggaagaacattagagctagtaggtaacacacacgcaaagctaggtaacaagcgcagtcatatttggctgccttttcagtaacatagaagcttaggggaagatggggcatgaaacagaggctgaggatgttcaataatgtgctttgaatctcaacagaaaattctgcctgtacttcagtagctaatggggaactatgatttttaaaaagttatcattatgtaagatttcaaatatatttgaaagtaggaaaataatacaaatagctcccataaccctataatccagtgccaactgttatgactccatggacaatccacccactcacctcttcaactagattattctgaaacaaactgatatattattttctccataaatacttcagcatttttctcttgctgaaatattctctcatgagaacttttttcggaaagtacatatataataccattaacacacctacagtcttaacaaaagttcattaattgaatcaagtatctagttgctattcacatttgagctgaagtgggaaggaagtttaggaaaacagctcagcagaattcagtgactgtgtgttgggtgaagaagaggaagaacttgaatgagtcttaggtatctggcctgggcatccacatgatttgtggtgtcattgggtaacaggatttcagacagatgaagaggttccatggttacatgcttgtgtatgtgtgcataagtgatcagttcaattttggacatggtcattctgaaaagcctttgaggcatcaaactgtagatgttccagaggcagttgaaatcagattttgagaagaggagtaagatggcagggattgctgagccatacatattttcacatttggatacatggactaggctttctgagcaaagagttgtagtaactgtcttaaagggtgactgaatggcaagcgtaccttggagtttagtgcattgctctggagagatttaaaaacttttatctccaagagccctttgattacatttcaacttatattccaaaaataatagacctagatcattggtttatagcccagagcaaagtctctgtcttcctgtatgtctgtctctctcactttctctcctcctgatacatcaggtgctctatataatctccaagatccacaattctgggatttctctcctgtactacaacccctgcactcacagataaacatcttgccctgagatgcttttgagtaattaatgatgtattctctcatccagagatcttatgtttcctgactagataaatataaattttaacaaatatcaacaaagggaatattcttttttttttttttttgagatggagtctagctctgtcacccaggctggagtgcagtggtctgatctaggctcactgcaagctccgcctcccgggtttacttacaccattctcttgcctcagcctcctcccgagtagctgggactataggcgcccaccaccacgcctggctaattttttgtatctttagtagagacggggtttcaccgtgttagccaggatggtctcgatctcctgacctcgtgatccacccgcctcagcctcccaaaacaaagggaatattcttgcctattttcagtcaaaattgggaagcattttaatcatttgtaagttggagactgtgttagatagggagtgactgctgctgatcgtacagctttccagatgacgggctctgaagaaaacttcacaatcagagagggaaacaggaaagaagttaacaataaaacttagaggattttctgccttattctaagatttcacgtttgtggtccacgaggacttgccttgagcaagaactaagctgaagaggcaggtgagactacagataatgtcagttgtaaaaggtaaaagtcaatgcttacaatgggaaccttataaaaagcaactgtgttctcgtgtcttatttatcagctcagcaacaggataagatacaatggttatgggtgatgtgagtgaatttcagagaaagaaggtgtttttaaaataaaatttcaaggcattctcttccagtctatgtacaccttgtgatggaaagctttcattatttcttttgtttcgcacctcaatttaactctgtggaaaaagtacttatctgacaggtcaggtattaccatacaaaagaaagaacaagccaacacagaaacaatctgagaatttacttatctggaggaatgcaggttaaaactgtcttttagcaatttcacatagagaattgatagtcattggaatgtgtgtgatgttgaataagactagggatggtcagattgctcaggaaaggtgtttagggtgaaaagagtgagaagaaaggtagcataaagatgaacctatgtggaaagcatgggcagaggaaggagatgagtatccctaaagaataatagtcatcagacccaggaagagaaccagaaggagggagggagttgtcaacaagtcagatgcagccaggaccaggagggaaaagtcagctcgggcaatttaggaggtcattggtgatcttatcgagagcaacaacagcatgttggaagtggaaaacataaatgtaggcagaccagactgtcttttgctgtcatcatctttcactataaaatagaaaatagctttgtacgacattgcagtatgctgtatttgacatcagaggcttgcttattgaagaaaagtttcatattgataaaaacaaaactcataataaaacagaaactgttggatactatgctcactgcctgggtgatggggtcattcatatcccaaatctcagcatcaaacaatatatccatgtaacaaacctgcacatgtattcctgaatctaaaatacacttgaaattataataaaagagatacaatggatgtaatacctgttattaatgccctaaaagccattgaactcaagcgtatctctagtattatttctttacttttatttacctggtagaattttactaccatcttctgatggctccaagcctggagtcttgggtggaatgtttagggctactccgctagcctgattaggtcaggtaccagaaacgtgcaccaacatatcttcttggctgcttctgttaacttgcctgacctgggcagcctgatttcacaagtacttgattcaactctgaattcttttaagtcactgtctccatcattcttgcttggctgccagtccaatggcaaagatacataactctgccaagtcctccacctgataccaagactccagctgaatgaaaggctgattacttaaattcacattgggcaaccaatcacatttgttagtacatagcaggcccaaaccctttaaatgcatagctgtaagcacccatggagaaaaacattcaagggaagagataaaggatcttccccatcagcatataaaagttatccagttatggctttgatatggtatgcgtgtgtttgtgcgtatgtgtgtgtatgtatactctctgaggatttgagcttgcaaagcttcctgattttaatctgagtctctggggagctaccaattctttggaatgctgtagcattgctcagcatcaagttatgaacggttttagcaatgctgtacagcatgttactaacgcgggaaaactttctatcttaaaggagaaaagcaaaaagcaaaaactggggcaggggatgtcacactccctggatatctagataatagctccttggtgcattctcagagaatgctgtcaaaattggctggagtccaggaaatacatcctttttaaagtccctgcacatattcgtgtcctcaaggcactgcacacagaaaaatggtatgtgcaccaaagaaaatgctgtagcactttccatagtttaaagtcagagatgagatctctgatagtattttactattttagtttgtctagaaataagtgatctttatagtttctgaccctctaaaaaggaagccatagtcccttgtagttgctatggcgatataaacatccctagaatcactatagaatatagcatttctatttctctccctgaatagttccttatcttatctgaaaatatgatgtcaaaatgataaagtaccaactttttagtcaaatcccttcttaattttgacatgcccctatgaattgaccacttcactattccgctgaaattctgtaagatgtttatttttggccactctttctgcaaaaggaaattctaaatatacatacaaatggaattttaatttctgaaaggcatctgtacacgaatttatacaactcgagtccttaatattttaaaataggatatttgcatctctgattcacagtctccaataagttaaagaagaccctgattatgcactgtgaatagagaaaaattagatagcacagtaacttttacaaccggcagatgaaatccagatacctaaagtaaggaaaagcagaaatctataagccatgtggcttcaattcatttatctgtttgaaaagcttattgtttaaataagtgtttattgataatacagacataatatcagcctcaaatgtgagatatgaaaataaagactttaaaatgtgagtctctcccttaagaagataattggtttttaaaggagacacatacagaaataatttgaacataaaaatgctttgtttattcaagtgttgtggagtatgtgtctttaacaggataaaaggagaagccagagaatacagaaaatttatctaggaaacaaacaagggacctatttgccaactaatcagtttaagataaaggtatgaagcaacccttaactatgctccattctttatcataagggatagacttctactgtttagtttttcttccatttaatgtaaagtgacaactactcccttgctgtcaaagattttcattgcagagcctgcctttaccatctaaatggtaaacttatgtgtataaatgtcaaagtagatattgcagaacctgaagagaactagagtaggggagagtaatatctgacaaattgaacttactgttaatcacttttgatgaaagtaaacttaaaataatttactgaagttttaaatatatttttgtacctatagcaaagctcgttgcttcccgaatactgtgaaaagtgccaaagttctattatttaaaatagcagccgggcgcggtggctcacgcctgtaatcccagcactttgggaggccgaggtaggtggatcactttaggacaggagttcgagaccagcctgaccaacatgtgaaaccctgtctctactaaaaatacaaacattcaccaggtgtggcggtgggcgcctgtaatcccagctacttgggaggctaaggtaggagaatcacttgaccccaggaagcggaggttgcagtgagccgagactgtgccaccgcactccagcctgggcaacaagagtgaaactctgtctcaataaacaattaaacaaacaaacaaacatcacttcctctgtcccgtctctgtggtcattcaattcagccatttcttcatcttcaacatccaattactaaataaggatgtctataatttacaagtgtctttgctcccttatttcatacctagaaataagctcacatataccttcacaaatctacaactctttccaagattttaaataatatgtccactgtgggatgtatatacaaacattaattggctaatttgtcttctgtttaacagtttttcctcagtaataaaattttacatcagaagttgtgagtgttctctcagtcaaaaatttcaattagaaaaaagtcttcaaatgaaataaaatttcaaatgtataaaagcataagttaaaatataagataatatgaaattgttgtttcagggcattttcccctgaaaatgacttcagtatttcgatgatattctggtttgaaatatattgaactttattttttaaaagaagtgataaaattgctttctaatggtttctcagttttcatttctctgaaggactaacattagcagacagctggaagcacttataattcacatttttaaccatatttatttcctgaaggaaattcctattcactcacttagtaatagcttccccatttcatctttccctccttggcaggattcagtacagttaggcacagttttcatcatacagacctagccacactagttttaactagtaatactatcttctaggtttctctctctgtgtctgacagctacatcgctgtattcattcattaactcaagaaatatttgttgaaaaaacctaccatgagacagtcatattttatttatttatttatttatttatttatttatttattatttatttatttattttggagacagagtctcactctgtcacccaggctggaatgcagtggcgcaatctctgttcactgcaacctccacctcccaggttcaagcaattctcctgcctcagcctcccgagtagctgggattacaggcgcccgccaccatgcccggctaattttttgtatttttagtagagatcgggttccattacgttggccaggctggtattgaactcctgaccctgtggtcacccgccttggcctcccaaagtgctgggattacaggcgtgagccaccgcgcccagcctgagacagtcatatattatatcttgggtatatactagtgatccagaaagcaaaagccccgctctctggaatctcaccttctacaggagaataaagtaaacaaatagagaaatgactaaactatatactcagttagatagtggttaagtgctgaggagcaaaactaaagcagggaaggaagaaatgaaggataaagtgggggtcagaattttaggtaagaggggtcggggaagaccttaccaggaaggcagtttttaagtaaagatctgaaggaaatgcagaaattaaccattgaaagaaaaatcatgagaataatattccagacaggtaaagcaagtataagggccctgacactggaatgtgcctggaggagtggccaaggaacatggaggaagtgattatggctggagtgtatgagctagcgactaccagagaaatatcagagaatggggtgggtaacccatgaaggtacttatgaacataaggacttccctgtttactttgagggggatggggagcattgggggttttgaacagaagcagaaagggggatataatctgactttccatttaaataggtatctctggctagtatattgacagtagagtctacaggggagaaggcaatgagggggaaacttgttaatagacaactgcaatcatccatgctggagatgatggtgctttggatcagagtggaggcagggttgaattccggatacattgtaaaggcagaatccttaggatttggtggccaattacatgtgtgttggtagagaaaggccttaaggataacatgaagaattttggcacagacaagtggaataatggagttgccattaactatagtgtagaaaactgcaggaggataaggttagggtgtaagattttaacatgctaaatttaagatgtttattatacttctaagtgaatatataaaaggcatatatatatatgtcatgattcaggagaggaatcttgactagagatataaatttgagagtcactaggggtaatttttaatctcttccaaacttgctcagaaaatactgatgttttgctatattccctttccagacctcttttcttccaaacccaaccctgtagacaatcttagccatttctatcacttaaatcaaactttgacacaaaggaattttatttaggggaggtgggaaaggggataagaaaaatgtcaagttgggagcatagattcactgctgctggggcccaacagagaaggcacccagcaggaggagggagttagccctttgatggttgattctgcttaaggctacatcaaggtgttttggggataacagaaatcgaagaagctagaagaaagtacagggaaaaaattcaagtctacaggttggtagacagtcagagactcttggttctgttgccatggtgggattatatacaccttccagaaaacctttccttaaccaatcagagtatttatttaactagatagaaatatgtatcgggaaatccagtccacattttgcactaacacaggaaaatgggtgatctaggatgttgggcatctcctgagtgaactttaataatgagagtcctggtacagctactgaatcaagggtatggtttataaatcggtccagctatgctgaacacaaatatctccttacttattgttttatctctttatttttccttgtgtccaatttatcctgccattttaaggattatccctgaccaaaatccatccatgatgacatatagctttttggacactttcaagcccatcttttagcccatctttttttccaggaaaaaaaagaaaaaactggattcacagtttttatccaacttgatttcctagtgctttgccagcagagacacttgaaaggataatcaaagtgaataacaaagtgaaggattaatctctttgttattcttcagacacatccttctgatacaattttttttttttttacccttactgactttgtatctttaactttgaaaacattttctgcatcaagaaactgtatagcgtagtgcttaagagcagaaactctggagcttgaacatccagagtgggacttcaactatgatatttaaaaatgatctcacctgagcaagtcacttaactgctcaggacctccgtttctccatctgagtatgggtataataatacagccttccttgtagggctgttatgatgaccatacaagttactctaagtgtttagaatgtgtcctggcacaaaaataataactgtcagctattacattcaagattagtccagattccagttatattcacacctcaagctaaggattcctcctctataaaattcctcctagtttctgctttttgtgctgctttcttcttttcatgatttcagttacactcatgtcttatatatttttgcttggatgatgtccttaatgtctttattactctctaacttgtttgtataactataatatgtatattcaataatgttatcaactaccagagtacaaggattattccttaatatttctttcttatcttttagaatgttaagcatagcacttgtagcattaataaatatctgttgacttgaagtaaaaagttgagttgaacttgcttatgaaaatccaatttgaattcaatcattgaacctctaagatttgttactctgttcaaccattgtagatagatattcaggtatggtcagacgtgagctattcaggtaattccttgtttattctactttacttttacaagacattagctgttgaacagtggaatagaagtccacatgcatttcctggctgagtttccttatggtttcctcacagcacattagatatctaagaaaaaagtcctttattcagaattacacctgcccatttctccagatgccacagagcatcaacaagaacaaaaagaacaacaaaaaaaaccctgcactttactgatccaagtgtttctcagataaaatgattctagtccatcagcactaagtaaattgaaaacaattttaccagtccttttatgatacgtacattttgtgttaagttgtacacatcgcctaaatcattttacagaaaatccaaatagaaaaattgactcacatgcatggcaaagggggttttatagaagtaagtacttttctcttagttcaaaatatatggcattctatgatcccaaatttcttagagtcaggatacgctttagtgttgtgtgactcagcagaggagggccaggtaggttttatggaggaaaaattccaaagcaatacaacaatccaagaaaacctcaaaaactgatgatcaccaatgaatggaatatgcttttttaaaattcatgttatactttttaattctatttacatatgcaatcatgagcatcttattattttgataaatgaaaatttagtataaatgattaagcaacttcataggtagctaccatacatgataaaatataatcaaacctgcaaaaattaatattgatgacagtaaactattttggtaaaacagaaaacatatttggtaatattatgcccgttttatatataactaatacttctgatgttggggaaatgtgctttccatcatattgttttacacaggggacagaaaagcaaaatcgctctttcatacaattgttctgtacccaaatgcatacatctaaaaaaaaaaaaaaaagaaagaaaagaaataaacaaaaggcatgatatgggagcaggaagctaacactctactcaatgtttacctttttggaagctccatagatttccttactgataacactatttaatttttgcctgtggtttggcaaattaaatttgggaattggtgtctgttaatcatacgtgatttacaacagaaagttcttgttttttttccatcaggatgtttaatgatatatattaatattcagaaataagcagacttgggtacaagtcattgtattaaactataagatattgccaatatttaaaccttttgaaagacttgacaattcataaggttcaatggaatagcattataattttaatatgttcatggttacaaatttaaccaggagaaaataaatacaaactaacttttttaaatggcaaaggaaagacaacaaaaaataaacaacaaaagcaaatttcaagactccaaagcaaaaaagagaaaaaaacactactgattaaatcattctttgcttagagtttcaatatttttcaataatttttgtcatggttctgaactcacaattagaacaatgggttttaagttactgaactagaaatggaaaaaataaatcaacacatttcataaagaaactaaagcccaaaataaaacaacaattaaaaccaagctagaaaacagcatcctcttcttggtaaaagttatggtacacagaatcttggaataatttagagttgcatttctgcacctcaagataaatatacaataaagtgagttatttgttttataccttaaataaatagaagaataaaaaaattactcctgaataagtaacaactagcctcggaaatacacatggcccccgtcttataatgtttctacttagtgatttttcaactttagggtggtgagaaagtgatatacattcattcgaaaccatacttcagtatagtattcactaaattgaatgagatattcaacactttactataaaataggtcttgtgttctatgactttgcgcaactgtaggttaacataggtgttcagagcatgtttaaggtaagctaggctaaaccatgatatttggtgggttaagtgtattgaatgcatttccgcatacaaaattctcaacttacaatgggtttatctggatataaccccatcacaagtcaaggaacattctgtacaatagaagaatatgatcaaaagtttgtaagatcctctaaggaagattttgtcaaaagcaaacgtggcttagcttgtatgtattctcttattttaaagtttttttagctttagaatatttgccacatctggaaataactttacgtatattttatgtggttaacattttatttacagttttttaagatataaatatgcaattttataatgtttaacacattcttaaaggtaatttgtttttaggatactttacgtggaaatttataactttcttagaatttgggatgtttgatgaagcaatatgcattttacaaatcttgaaatttatataattatacattttaacaggaattttcctacacagtcgtacatgatttcactgtatcttcacaagagtacagttgagtaggcaggggcagttattatcactgatttaatttcaacgttaaaaaacaggcctaaatatcttatgttacttgcccaagggtacaactatcaacaatcaggttaaatctttctaagcttttcaggttccaatacagtactttgctaaactctctactctactgcttatcataaccacataatgaaagctcactgatgtggaaaaatgttagtaatgttttaattatatgtgggttccctgtcacacattttcataaatgattgttttagattcagtatatacaaacctagaacaatttcttcatgcttatatgcatatagatttgtagaatgcacatgtctagatgatttaactcagtgagttaggatacaatataaaaagaagtaaatttggttttctcttttagtaccagcgcttactaacactgccctgtcttcttctatctcagagtccacacctacatgtatcagaccatcactcactaattcaacagatgtacattcagtacctttaagtgctaggtgctgttctaggagttctagatacagtggtggaggaaaaaaacaacaaacaagatactaatttttcttcctggtggctgtgtgtatgtatcaccttcttgaaaaatgtagcactgcagttacatgggttatacatatacttaaatgcatgtatagtgtttatagacttataaaactctaggcactattgtcgtcatattttgggaaggtgaaaataatagctttaagcagttttaggtatcagaaatgccttgagacactttgtaacttggttaacagaggagcacataactttcatttctaagaaaaaaggattagaaaaacccattagtaactgttgtgacagcggccgttggggagtagatctatcttaaaatggaaaaagagaaataagagaaccaaagactcaaactccagttcattttcactctctggaatttgtctttatctgacagataaaggcaacaccctatataaatctaattcttacactcttcacatcccatccagctaccaggcactacattaatgacatatcgaattgggaactgtgttcaatcaaaaggcattaaagtacttattaactaggttttacggagcttccaaaaaaagttaaaaagttatttttggtggctctatggtaaggtgaccttttaattttttcttcatggtttattgtccccatgtgagaaaacactttctaaacacagctacgtatttggaccaaaatattcttcataggatgatgcattgtctttgcataaataacgaatcagtaattatatatcacacataaaaaacgacattataactggtcgaagcacagcttcaaccgtttgtgaataaaaggaaaacctccccacaacttaactgcaacttcaaaatttctaccagcctcatgatttgtaagttttaatatggaagtttctgctttctacactttacacgatggggattatgaaaacagtgctgctgggagaatggaaggagtaggagtgcgttcttaaagtacattttagcagagttgggagtaaattgcagcataatagtcaaggtaggacaactgctaggcttgataaaataatggttggggataaagaatggataatttcctacaagagagatttgtataaaatataaaagaaaactgtaccgaagcacatataaatatgagctgggcatgactgaaaggcagtaaatatctataatctcttctctatagtacaaatcttttcatataatacaaatgaaaaataatgtactatggaaataatttaagcatgatttaaactacagttaatgattaatatttgaaaatacacacatttatatatagcaaatcaatcaaataaatcccaagtcatataagctgttgaagaaacaaattatatttataaccaaataaatgtgttgaaaaactcaatttttctaagagaaaccactgatcacattattgcaaatgtttatgtatagttcaaaagatcagtttctacaaagtcacaatgtattaataaaaatcatcttttccacgcattaaactgttagaactattaaactattagaaaattcaactcgaattcaaaaagcatttgcaaacaaattttgctttgaaattttatatgatccatgattatttagagtaattgcaatgtcctcttattccaatattattaaatacccctgtattacaatatgcatataaacaatgtaatatgcccctgtattacaatacgcatataaacaatcgttcttttattttccttcagatattttgtttggatttctacatatggtgcctcttgctattatctaattctcctaataccagaatagaaaagcagtcactttgctcatggcataattttgccttcatttaactaattgggattattaaatttgtgcttaagagctgtgaaacagattccagaggagaaagatcttaaccagtgtattaaaaatctctgttgccagtacttttgtccctacttcaaggcaagactgaagaatcgaagactaaaatatgagaagaaatcatacatctctcaagggatcttctgctaggttttacgagaccaaagttctaactcagccccaagtcggccgagaatgggttttcatagacacatgcttaagtttctgtatgaccagagaaatatatctgctatctctaatttcaaaatatttccagaatctgacattctctcactaccgaccaagtccaagccaccagcatctctttttcaactcttgttgattctattattggtcccctacagttctactctcaacccagaagccagtgtgatccttttaaaacatgattgagatcatgccactcaactgctcagaaacttacaattgctctcatctcatttagaatcttctttacaatggccccaaaggccctccacaatctggacactcacaactcccatatcctcatctctttctacccttccactggcttgttttgcttcagccactttggccttcttgttggtgcttgattaagataagctcagtcccacatttgggcctctactctatttcctctacacagactccatggctgactcccttaccttcttccaatctttgctcaaaggtcatttctaccctatttgaaatggcaattccgccactttcaattatacctacgtctacccctgtagtggtcctatatccccttaacagattctggtttttttttttttcccaaaatacgtatcacctagtaatacgcaatatttacttatcatttttctttgtttgcttgcttctattctgtctcccaatgttataataaaagctgaatgagggcaaagattcgttagtctttttcactgttttataagcacttagaatagtgtgtggtacatactaagagcttaataactatttttggaatatacgaatccacattccttaggtttacttgtcctaacaattttttgtttctcaagagcaatgcaaaaaacctgaactcaagaggacttgaacgacctggcttcacactatctttggcttataagctcactaccagctttcccttgtggtctcgaacttgaacaagggttgtctctatttcttgatcctatttaaaatctacattaggaccaccatgtctcctacccgtgagctttcttcatatggccacgtttttcatcaccctcttggttacccaaagtatagcacattttattcattccaaacaaggcatctgtactataattggttttgatgagacaactgaaatgatgtgtgcctgatattttttctttccttccatttatttcctccttgtttctctccttattttatttcttttcttcaattctccctccctccttccctcactctctttcttccttacttcctcccttccttcctcctcctttcagtgatttgaaactccagtgcaatgtggaatattgaagggatgtgggcagatatccttgtcttgttcatgttcttcaggtgaagacattctgctctaccataaagaataatattagctgtaaattgattctcattattgcaaaaggtaaagcatagttgtcattcttattataagctatgttcttatttttgtcctaaaaattcacatttattgataccaaggcctaattgaacagctaaggattccctgaatgagggagcagcagaatcacttgaagaattccactccaaaggcatgaactatttctaagaatttctctacgtaaatgctaactacacagtaaatatgtcattatttatttcaaaaatgtcctagatagagttcccctataagcagattcgaagacaagggatgtctttgggaatgatccaaggaggtgctagtaaagtgtgtgtaaggtaggacagggagcaagtgaaatgtatcctatgaggcaggtttttactgtgtgcgatggggtcttaatcctggaacagaattttgggtcagagcataaatcatgcttcagagttaccctaactgaagaatgagtgagtagtggtatttatccaccaaaagttatttgttattggttgaggtttgctggggaacacgggggatgcagaactttaactacctgacactcatgagctttgattactagagagagccctaaggcaaacagtcagagacacttggatctggcagctaccagtcagagtacaaggcatgctgagtcaggaaatgatatgggtgacatcccaagagtgtttcatcctccaataaaactgatgctttcagtaaaattaggcatatggacacatgatgataaatcctttcagttaagtcttttaagtggatcatttctgcttttaggataagctttcaaatatttaactctctccagagaaaaccttttggtaatttaaaacttacgatgctaagaaattctgtgttcatgctttcatatgagatactttaaggcaggatttgacggtttaacacagtaattatattttggaaaattttatcatgaaaatgattttttcttaaaaatgaaatgcaagttaatattgctctaaacttccaaaaaattgcaattcttctaaaattatgtactcttgtctgttatgagtattattaactttgtacatataagcaatcacaatcaattaactgttaatattggctctgaagtaagaaagaaaatattacttatgtgtatgtttctcattcttctctagctctgccttagctagtgtttttgctattaaatgcagatttccacatatgtatatatatatacgtatatatatatgtttgtgtttatctgcatagtctctgtcaacatgattaggtagctttccaattcaatacatctattgaaaccatacgtgctattttagttgtattttgtttagaaagtaattcttttaacatattacatattatttgtgttgtactgcactttcaaaaaagatgtatgttaaagcacagcaatacttactatagttctgtaatttgattcatgcatatctgtcaggaataaaatcaaccacaatttcaaaccttcccaaccagcagctgtacaatttatgcactgcttttccatttttactactggataatgacaatgatgaatgcctttaacaggaaatacatattcactgaaaagactgagctcaaaactatcccccttcaaaaaagtcaatgaaggtaggaagcccattcacctgctggagatttgttgggagacagaaggaatcatgcccacaactgtatcttatggggattcaaccatttagctaaattaaatctacaataataccatattataaaccgcagtaatcaatactattacgattgacatcagctataataatattaaatagatcaggatgaacaaatgattcactgtgagtgtagccaagggtctaacattctgagtatgccaggctaagaggtatggagacagagttattcaatgggcaacttaataagatcagggtcactactctcctgaaccaaatgtccatgaacctgggaaggaatggatattagctcattggcaataatttacttattgaatgacaatgatgcacttacaaactatgctgccatgagaacttagttaatagaaataatgacaggaattctggcatgtcagctttattttattaactgattaggtttcttttcttcattgtaccaataagtgatttgacttttacttcaaacagaataagaaacagtgccacactgacatggatggaatagttccagagatctgtgaagctcttattttactgtgtaattttatagcttatttgatataatgttaagatattaaagtcaagtcactgaagatactgcaacaccgatttccaaaacaaacaaatagctttatccatttgtatattcatacaggcaaatgtgtgatatagaatgagcttccaggaaaccatttgagtataaaatactttagctaatatgtgctgctgatagcaaacccatcttttgcctataatcacatactgtttgcatttgaaaataccaagctctgggtatactataatatttcattttgagtgtaaaatgtacgatcatgaaaattatctggagacacattattatgtgcattttcttgatcctacattcatttatcttcagacactgccttctgaaattcatagcctatttcatcatcattatttgccttacttgagaatttagtaacttgctgttggtggtttgaaaacagctggattttgttggtagcctttaactggcagttataaagaaaatattttattgatttctattcaattttattccatatgttatagcacaggtattgacattaatttgaaattgaatatgtatacataaaaaatataaaacaaaaacaatatacattacatataaatgaaaaatctaatttccctttttggaaaatgaaacagaagtcatccattaactaggaataaactgttcttccatcaaagtttatttactggtggttcctttctgtccctactgcatgtaaaaatgatcatttttgtgcatttcttcattttaggatgtctctcaaagctaaatattgtaaaatacattttctaacttatgtctttctaccctagatttctgaagccaaccacactatcaagtatttttaagaattccatgtgaaagtcaaaatgccatcatgatgcatacaatttaagtcaattgttctggcactatgaatgatcagtatgatcaccttgtaaaatacgaatgaaagtgctttggttttaccttcagagactcctcttgcttaaagagatcttcaaagtccttagcacagaggtcaggagcattgagaagttgttccacttctaatagggcttgtgagacatgagtgatttcagtcaaataagtagaaggcacataagaaatttccaaaggcatgtcttcagtcatcaccatcatcgtttcttcacggacagtgtgctggtatagatatacaaaagaacaattttttttagcttcctaacagtgaaacctcctccattaagtttatataggtctcattctacagctgacaattgaatctacaaactgggctgaaaatggattcaaaacctcacgatggtaagtctagtaaaacggtgatttattaattatatacctactttttccagaaagtgttaaaagcatttcataataagtgacacacacatattagcaccataaatataagacgaaagaccatgaggtcataaggagagtagttttatcctaagaaaaagacgatttttgcaaccggcatttaaatttctaattctaatttgcaactggcatttaaaattctaattttcctggaaatctagatatgggattgggtgagggggactcatatctgttttattcctaacacaggcaactttcctgtatctataggaaagttcactgagatacaacagatacgaagtagttaggctggtatgtaactttgtattaagccctcttctcctccaaattctagacattagctcctgtttttgttgctagtctcttgctaagttaagctgctaatgaagctgctatatgagcagaactgactgcggaatttatattttaaaaagaactccagaatgtcctgatatataagggagcactagcctcttctcttgcacctacacttttctgactgggatccaagtgctagacatgatgagaatttccagctccagagtccttttggagtttcccagtaatacatctttccctattctttataagagcaaaaaataaatactacttggcaggcaaattcagaaagatggatgacctgtgctctcttctgtctacactataggcagcaaaattcttgtaattgaaattattctcccaataactttgtctagaattgatcaactgccacctgcctgttgatgaggtcacctgagggtttcagtggtagggtctctggggaagtacaaacgataagcatgctaacgtagccatttattactgcacagccttttatgacaacaccatacttatttttgcagtaatgtaatacattggactttggggatactagactgaaccccacacaaagaggagtaaaatttacaagctggtcactttatgttttgtttttaatttctctgacctaggattttcatactcaattcttacatgatataaaaaatgaagtaattctaatttagatatctcatctacttgtgatatagcaaattcacagaattgcacaaattagctattaaataattataccttttacaacatttgttttattgtgtatatctgggccaaatccatggcacacattccttcatgttcaatggaataatgtatatatatttctcatttacatttaaaaggatattagaaacttgagccagagtttgataaataaaattcagaatttaacagatttcttaagaaattcttaatttcactatttcatcataagcattttacacatttaaaagaaaaataactcagcaggctatttgaatgtgaaattttcactgacacattaaacagtagaatcaatagcacaagtaacacaagcttgtgttttgcacgcattacattggttggtgaccattatgttgttcttaataaaatttacaagttaataagctcgtctttcttattcacgttagttgctataacccctgcagtaaagatagcttcacatcatctaaagcaagcgtatttcttataatacttatttaatggtgcaattaaatctgcctttaatgatacattttacacctgtaagtttttggaaaacaaaggtttttgttatcaggaacagagtaagtagaagacaagttgtagtttttcatttatttattaatttgttttgttgtttaatcaagggagttgtttcagaattggacatatcttgaaaatatttagaaaaaaatctgggtggccttaacaaaagcagtgggaattcagaaaagttttgatgcatgtcctcatcactttttcttaaaagaaaaataattctaagatgtttttatctattttctgattcttctttgatatgtagttttctcagtcttcattactttcatttgagatgctctcagctatcttaaattcatattggtgcttaataaatatagtaattgtggattatagccagcaagaaacttagctgtatggtcaaatataatgaagaaaaagacactcaaaatatactcacttttgtctgctaacttgtatttaacttccttaaatgaaatttcaaacccaaattttgactattttggtatttgcagaaaggaacgttaaataaaaatgagatttgccaatgaatccaggagctggtcttttgaaaagattaacaaaatagatagaccactagccagactaataaagaagaaaagagaaaagaatcaaagaggcacaataaaaaatgataaaggggatatcaccaccgatcccacagaaatacaaactaccatcagagaatactatcaacacctctacgcaaataaactagaaaatctagaaaaaatggataaattcctggacacatacaccctcccaagactaaaccaggaagaagttgaatccctgaatagaccaataacaagttctgaaattgaggcagtaatagcctacgaaccaaaaaaaaaaaaaaaaaaaaaagcccaggaccagacggattcacagctgaattctaccagagatacaaagaggagctggtaccattccctctaaaactattccaagcaatacaaaagaaaataaattcttccctaactctttttatgaggccagcagcatcctgataccaaaacctggcaaagacacaacaaaaaagaaaatcctcaataaaatactggcaaaccaaatccagtagcacattaaaaagcatatccatcacaatcaagtaggcttcatccctgggatgcaaagctggttcaacatacgcaaatcaataaatgtaacccatcacataaacagaaccaatgaccaaaaaaaccacatgattatctcaatagatgcagaaaaggtcttggataaattcaacaccctttcatgttaaaaacactcaataaactagttattgatgggacaaatctcaaaatattaagagctatttatgacaaacccacagccagtatcatactgaatgggcaaaagctagaagcattccctttgaaaactggcacaagacaaggatgccctctctcaccactcctattcaacatagtattggaagtcctggccagggcaatcaggcaagagaaagaaagaaagatattcaaataggaagagaggaagtcaaattatctctgtttgcagatgacatgattgtatatttagaaaaccccatcgtctcagcccaaaaactctttaagctgataagcaacttcagcaaagtctcaggatacaaaatcaacgtgcaaaaatcacaagcattcctataaaccaataacagacagagagccaaataatgagagaactcccattaaaaattgctacaaagagaataaaatacctaggaatacaacttgcaagggatgtgaagggcctcttcaaggagaactacaaaccactgctcaaggaaataagagaggacccaaacaaatggaaaaacattccatgcttatggaaaggaagaatcaataacatgaaaatggccatagcgcccaaagtaatttatagattcaatgctactcccatcaagctaccattgactttcttcacagaattagaacaaactactttacatttcatatggaaccaaaaaagggcccatatagccaagaaaatcctaagcaagaataacaaagctggaggcatcacgctacctgacttcaaactatactataatgctacagtaaccaaaacagattatactgatagcaaaacagatatatagaccaacggaacagaacagaggcctcagaaatatcaccacacatctacaaccatctgatctttgacaaacctgacaaaaacaagcaatgtggaaaagattccctatttaataaatggtgtcgggaaaactggctggccatatgcagaaaacggaaactagacccctttcttacaccttatacaaaaattaactcatgatggattaaagacttaaacctaagacctgaaaccataaaaactctagaagaaaacctaggcaataccattcaggatacaggcatgggcaaagacttcatgactaaaacaccaaaagcaacagcaacaaaagccaaaattgacaaatgggatctaattaaactgaagagcacagcaaaagaccctatcatgagagtcaacaggcaacctacagaatgagagaaaacttttgcaatctatccatctgacaaagggctattatccagaatctataaggaacttaaacaaatttacaagaaaaaaaagaccccatcagaaagtgggcaaaggatatgaacagacacttcgcaaaagaagacatttacgcggccaacaaacataagaaaaaaacctcatcatcactggtcattagagaaatgcaagtcaaaaccacaacgagatagcatctcacaccagttagaatggcgatcattaaaaagtcaggaaacaactgatgctggagaagatgtggagaaataggaactcttttacactgttggtgggagtgtaaattagttccaccattgtggaagacagtgtgcagattcctcaaggatctagaaccagaaataccatttgacccagcaatcccattactggatatatacccaaaggattataaatcatcctactataaagacacatgcacacgtatgtttattgcagcactgttcacaatagcaaagaattgcaaccaacccaaatgcccaccagtgatagactggataaagaaaattgacacatatacaccatgggacactatgcagccataaaaaagaatgagttcgtgtcctttgcaggaacatggatgaaactagaaaccgtcattctcagcaaactaacacaggaacagaaaaccaaacactgcatgttctcactgataatgggagttgaacaatgaaaacatatggccgcaggggcctgttggcgggtggggggcaaggggagggatagcattaggagaaatacctaatgtagatgacaggttgatgggtgcagcaaaccaccacggaacatgtatacctatgcaacaaacctgcacgttctgtacatgtatcccagaacttaagtataattaaaaaaaaaaagaaaaaatcattcagtgacactggataaaataaaaattagattcacttagaaaataataattcgtgctctcagaccagaattctgtgtctcagcaaataagatccagtgttaatcatagtcctaaaccagggcttaaagaatgtaggcagcacaccataccctggcttctcatctgttaagcttctctccacctgaccccatgtgtctaccatagattattatataccgatttaacaaatattcttcagaacattaaactaaaaaccattttcacctatctttcaaagaaaatctcttttagaagagtgttatgtggcatctatttaaattgccaatttttctggtaatcatccttttactctctgtacaagagttcaatttttaagaaaattttagatacctaagtgacaaataattgtaattctgtatctggttctagaaatcattttttacaaacttttaaataatgaagaagctcttattaacctgatcgaaatactcttaaaagaaatattagccattgaactgcaggttgagaatgctctaataatatgcatattgtgattattttcaagattgtcacaaataagccatagagcaaccagtgtcaatacatggaaataatccctacatgctcagccatggcatgaacacattttctagaacacttagaaatattaaaattcttatggttgaacataatcaataaaaaggtatagtttattactttagaaaaatctgaatgagaaaaatcatttctatcctcaactactgataattaagtaatctttcaaaaatttttctttccattataaagataaattagaatacctgtaatttctaagatgcttctcattacaattacctatgggcaacagttcagctatacgttataaagtctaaaaggttaatgttatactttaaatatatttaatgaagacggatctattgaaagatttactatcttgatacgtagtgtccagtcatcacagataacagacactaagtggtacagatcagctgactagagaaaactaagggttgatcctgtgaactttcttgagaaatagaaatattccaaaataactttttgacaccactgggaaactgtgaactcattttctagaaaattccgtgttattaagtttgaatattctcatttattatagcaatctgatatatacaataatgtttaatatatagacttttttgtaattttcatatacaagaaactaccagaaattgaatcaaaagagaaccagacatttggagatctagtttgctatctattccttaaaagtatagcattcctattgacacagtcatgcgaatctataatgagaaaactacatccattgaatgactttcagtttggtttaataaaaatttcagacagttatttaaaaatcagtgtaattagaaatatcatgttcattttctcttctttatgcaaaatccaggtactcattcagattaatccttttcatttgaatttcattaactctgccttgaataattttatccttctgagttctgatgtgtacaaatcccgtctaaccttttgaaaatcaacttgcttttgttaatgttctttaccaccttatatcattatagatactcatgcatcattagcaaggaaatgctataatctgattaattcattttatttctttgtgtttattttcatttttaaccatatataccccaaagaatatactagcctcattttctagaaacaaaaagatatgtgaaagaaaccataaaatgcctatttttatttaaaaatgaaaagttcgatcaatgcttaatgactattatagaacacaattatgatttgtatgatctaaacttaaagtcaaaacagttttaagattctgagctgtgtaaataggcacaggtatcactcacaaagttttgaatacattttcattcatctgaaacttaagttatcacattcttttcattacataaaatttgtttcttgaagggccataactgcaaaggataaaagcaatcctgttttgaaacaaatggtgcattatgtctaggtttttaaacaaaatgttttcctccatgatttaaaagacttctttctcctttaaatgcattgaggttactggcccatttatgagttatgaggtcaaagaaactcaagaagaaaaatgtgctatatgacatatgattatgacatatgccacaaaataactatatatctcatataaatatggcacatgaaaaatatatcaatgcatcaaaagtgtaacaaaaatagactattatcttgaccaaaaacagtaaaatagtgatggagcctttttttttttaactgcgttggtgttaatgaagatgaaaataagcaaatcctcaaagtaagatttattaatgatttagtgtgagctataatatgaaaatctatgagccataatatgaaagtatgtcagtttgtatctgattatctttcctcaaagggacattcttaaatattatggattatttaaaagtaataacacaatgatatgtaaatccaaaataggactgcaggctttaagtaggttctgatgggtcataaatgaaaaggcaatgggaaagacttaagtcttagacaagtagctctgtctcttagccccacaagtcttcagagaaagacaagtttccttctaggaatcattacagtaataaacaaagttgagagattttttatttatttctcctggacaattataataggcattgtaagcataaaaatgcaaatcacaaacaaattaggcaaaaatattgtattggtccagggtgattaaaaaaccccaaacaataaagcataaaaacaaaacaacatgatgcaggtgagacgggtatggttttaatctgcgttgtcactgttttggatacatataatggcatgacaataacagcattctgacagtacttcgttttgtctgttttagtcaagtcactgggtagaaagatgttgaataatcaatctaatgagtctaagcatattggttatgaccgtgcatagaaaaaatagcaatgagagagtgtttgctcttatgtgatttcccccttcctattgcatcatctaaaaaattgcttatgtgaagctatgtaaccaaaaaaagggcctgtccatctcagaataattattcagaatcaatgaacaatttaccccctttgtttaaaaagaataaaactcactaacatacacaaaatagtcaaggtaaaatatgaaagaaaatcatcctttatgcccatattatttattttctaaagttagaattaatttttaaagcagggcaggctgtcagcgaaaaagatatgcagatgatgctggatttgccagtctttaaatacaccctgcttctagaaggccaggtataaatagtgtcctatgtaaaaggtctggacagacctgctcattgacctgcctcatgtggattctgactttctacaccatgaaatttacctaattcctcagggccaagctcaattactatcaaattaagctgataaactgaatctggaaaatgtgttaatggcttatagtggtttaaagtctttcgtttcaaaggacaacatttgcatttttatacagattttcaaagaattaacataaattagtaacttgataaaattttagtcactaagtatggcctgtgagagaagagaaagaaaagggctttggttgccaccaagataagtatcaacacataagcagcaatatataagcaccaacaatcatggcctgctttgtaaaaccatctccaaaaaataacctataaattaatagataaggttatacaccctagccaacttataaggcagcaaaaaataaatgcagcaaagactcatgcctagtacctagcatacagtatgttatcaaaaatatttgttggataaattaatgaaaaaacaagtatcaacttaacaggataattataagatagatatgtggttacaattgctgggatttacatttataatttatatttaggaatattcagaattcaaacaggaatattttcttcattttataatgcaatctttattgtcatagatttaaaaggtatatctgatttcactatgtcgcatttcttcaattcatagcacattagctacatgctattgtacatgcgtgcttaggtccttaaattgtcttttagttactaatctgactcattatacttgaatacaaacataagcaattatttgaggtaatgacatatagacgatattaagatatactgattttagcttcttcatgggtatcataatgtctattagcaaattgaagggtatgagaagacttgtattcaaaaaatcattttaacctttgataactcttcccaaactcttctcataaaagttttcgtttacatatctagtatatattttttattttaagctattccaaaatttcagcttgggaatacttgctatagcaatctttttgtatgttgacaagcaaatcgaaccctccctccacctcacacacatacttatacttaattcagtgtgaaaataaaagtaacacaagaaaaaataagtatggaaagaccttaaatactgcagttatatttcaccctcctatatcgcttttaacttctgttgccttgtggatctgtcaacttgagtagatttttcagaataaactcacacttttatttctatattacatttgtcacacccctcagaaaatgtggacactatctctagattaatgcggcaactcagtatctatgtctaaatatgcatgtgtcataattatgtttttcaaggaagtattctcttcattagaaatgcgagtgatagtaaagatgcatataattacactatcccgtatggtagtcattagctacacttgacgaaagaaatgtaaatctaaattatttaaaagcaaatacaattaaaaacttagtacatctgtttttactagccatgttttaagttctcagtagcctcaatagctactttattggacagtgtagatatagaacattgccatcatctcagaaagttctataggacagtgctaatctagagaatgacaatacattttatttatagaaaaggttaataccaaagtatgttctgtaatcgttttttattctactcagtctctgtccaaagggctgtctagtacttaatgtggttaaagttacctaatgagcactcaattaatattcttttataatggcaatcatacaagaaagaaagatttgtttctttttcaaattgcttattaaaatataacaatgtgttctattttaaataatgtgaaaactaagattatatgaataattctaatgctggtattatatctatcagaaaatacttgtagcctagttttttcacaaaggtaatttagacaggctactaaatccaaactaaaatgtcacaaggtgaaaactcaactaatttgttattattctatatccaattgattttactgaattgctaatacactgtattttgttttcaggtagacacagcctaaatctgtaagtaatctcactcaactctgaagataattaatttaaaaacctattattgtgaattatacataatttgcattatttatatggtcaaagcttattaattatatatatgcacatgtatgtatgtacgtgtctgtgcaaatacagacacacaaaatagaaatgttgagaatgggtaaatcacatcgtagatatgttttctgtttcactttgaactgagtccatgcaacgtcaagataatcacaactaactgctacaatttagaagaatatatgtatcaggacctcaaattatggaaaaaaaaattgcaggtgaagagagaatgatgatgaactggtgatatttcaaagttatgtgtatcttggcacgatctgagacagaaatgatggatctgatggttttcaagtatatatgtggaatgatctgttggagaccattgatttaaggagatctgtttgacttaagaagggggtcagtacctgctagtttgtttcatgcaggcattactggagagtggctgtactacatggttgaggacagccttacttccaccccttgtccatgagatcagagatgttttcccatatgtaaattttgtgaataggtttcagcttgttaaataattattcatcagatcaaaacaacaacaacaacaacaaaacttccagtatccatgttgcttctcaatcaatcactatgcatcaaaatatcaaaaccttaactgcatttgcgccaagacattttacattctttgacttaggcatgagagaaaataaagcaaaggctttttcagaagacacaaggggctggagagaaagacaaagctgagagtccatacaagtagtatactagaagatacggaaggtacatttaataaaaataaaattagaaacattaaaaggttaacattagagcacagaaagcctgttacctagtttttaaataacaatagacaacttagaaaagagaatgatcatggctaaaaataaaatatgggttctttacagtcaaccagaagaagtatatcacaatttaaagacaaatagaaataaactgacattaatagtgaaaaaataagagacttagagaacagatctaagatacctattaagcaatgataagtaccagaatgagaaaaaagaagagatggaagatttgtaataattaaaacaatcataatagaaaattttccagagctaaagaagttattaatattaattggttatttaaaacgttacccaagtgcaaaaaagaattaaataagtggtgggtcacaactgaaatcccagcactttaggaggctgaggtgagaagattacttgattccaggagttcaagaccagcctgggcaacataatgacacatcatctctacaaacaaatgttttaaaaattagccagtcatggtactgatggcctgtagtcccagccactaaagaggctgaggcaataggatctcctgagcctaggagttggtggctgcagtgagctatgattgcatcgcggcactccagcttgggcaatagcaagaccctgtctcaaaaataaaaacaaaataaaataaaataaaataataaacagggacacatttagaaacatttaaaattatatcttaatgaaatttctgtacttcaatagatgggacagacagcaactttagagtttgagagaaagaaaaaaggttaaatacaaataaatgatacttggactagaatcagactttacactggaaacaatagtagcttgaagatagttgaaacaagaaaacaatggaaactggaagacaattgttcataacctacagagactactaaaaaaagaggagagatattaaagaatgttactatccaataaatccatcatgatgactgcaaagcaaagatcatttcgaaaatgcaaggtttacaaagtttacatcctttatgtttttacgaggacatttctcatgtgttccaaccaaattaaaactgaagtacagttggccctctgtatccatgggttccacatttgtggatttaaccagtcatcgatcgaacacatttgcaaaaatacatggatggctgtgtctgcactgaacatgtacagacatttttattgccattattccctaaacaatactgcataacaactatttacatagcatttacattgtattgggtactataaataatctagagatgatatgaagtgttcaggagggtgtccatagttacatgcaaacactatgccattttatataaataatttgagtattcttgaattttgatatcaaaatgctgaaaccagtgccccacagacactgaaggatgactgtgtaataaagatttcaaaacaatgagaaataaacggtacaaaaaaacagtgacaggaaatacaccttgtgtcgtttgtggtcaaattttatgaagtgatagtgtaatttaagtaataacatgacatcttgaactagtatgtgatactacaagtgaaaacaatagtagccaggaaataaaattataaattatttctttttaaaggattttgcctttgattgaaaataatgaggagttgactaagtaaatcatcttggtgatgagggcattgttcttatttaattttggcgcaacactacagaaatataggcataaaattgttgtttaaaatgggaaacagcactagtaaaatgatagtacaaagtataacttataaataacctataagtgcgggaagagatgcagtagagtgcagtgaagaagatgatgaattataaaattatagacaagggataagagtaaataaaatgataaaataatgaccatcaatatgacaaggaattaaaacagacacagttataagagttattgtaaaaatgaagttggttaaaatgtctcatctaaagatgaactatctatcatttttatatcttcataagatcaagcacgtattggtaagaatatgtgatttttttttatagataccagaggctgggaagagtgtaggtgggcggaatgggtgaagagagattggttactgggtacggacatacagttgcatagaaagagtaagtgctaatgtttgaaagaagagtagggtgactataatcaacaatatattgtatctctcaaaatacctagaagagaggagttgaactatttccaacacatataaatgataaatacttgagatgatggataccctaactatcctgacttaatcattatacattctatgcatgtagcaaaatattacatgtaccctataaagatgtaaaaatatttgcataagttaaaaagacaaaattatctagtttaaaatgcacactccatctataggctgtttacaagaaacataaaaatacaaggtcacaatgctgcgttaatggtgatttagaaaaccattttttaaaaagtgaaagtcacaagaaacataaaaatacaaggtcacaatgctgcgttaatggtgatttagaaaaccattttttaaaaagtgaaagtcaaaataatagcatcaaatgaagtatagttcaagaccgaaaagcactaaatgggtctcagagaaccattgtaatgacaaaaatcacacttcttcccaaagcacagtagtcattaattgctatgccccaaacaattgggtgcattctacataaggtaaaaattactagaaataaaaggagaacatgataaaatcatagctgtagttggtaccttacatacaactcttctgtaatttgttagattaaaatagacaaaaaatacaaataaaaaacaagaatagaggtggtttaaaaccgacaagctaaatttaatccgtattttgtgcacactggaaaaagcatattctcctatttacttgggacatcaaaaattacatagagaggaaacttttaaaagcatcaaaaagaaagatttgataggccaccttttctaatcaaaatataataatccagaaatgtagaagaataatagaatacattttgattcatcatctaagactttcacaaagaatgtataagatctatatacattacctgggaacatgtttctaattgactgttatatttaaaataatacacagaataaagcagtattttttaaaaaagtaaaatatatctatatatactattcattggtaagaatgaacagtatatggaatatagtacaaagagatatctaagactaaactatagactttttaaagactaaattgtagactttttttttgcttcagtgagggaggaatcagcagaatgaagaaatgaagagtagtaaagtttccttaatctacctttgtattaattgattaaagtaatactgcaatacatttaaaataatcgcacagagctctgaactagcactaaagagtagatgcaaatagatacagatttcaaggtaaattgagtctttacataacatatttatcagtaggcatggccccctctaattgactttattgttcataatagacttcacttctattcaagctgcaggaaggcatgtactactaattggctcccaatattatggaagcatagactaagacaaaattcagaagggagaatgaaagcattttgaaacaatttcacatcatcacctaaaaccatattggtgcccctcactgcatacccaattgacagaagagtcgtggcaaagactagtggctgctgttgcccatgaagtaaagagaattatttttaggtgcctgagattcctggagatgaggaaatttaacagccaatggctaatagcactcttatgtgacagcatccaatactcgatatattttaattgatcttaagtactcaattttttttttttttttttttgagacggagtctcgctctgttgcccaggctggagtgcagtggcttgatctcggctcactgcaaactacacttcccaggttcaatttataagcaactaattaaataagtatcactaatgagaaaaatacccaagccaaagtaaacatttagctaaggatattgtaatccataaaaatacaactttttgtttgcatttgaaatgactgcttcaattctccccatgtatttgaagtcactttgctaagctgaaaagttttcctctttggcctggcacattagaccatctttatttccatgcccttaacttgaagggacactaatgacattgtgatatactgataacagtatttacaaaattatctgacctaattccaaataacaagtttgagagttaccctgcattctattcttctttgaaatatgcacaacaatttcatatacctgcaataaaaagcaggcagttaaaaaaacacaactttaggaactcgactaaaagatggagaataacctacaaaaatcataatcttgatgagttcagcaggcatttttttcaaagccaaaggacatattttgctaagtaacttaatagatgtaaatagcaaataacatatagcatagctacataaataagcatatgtgtaacatatatgaatacatttatgtgtgcctatgcagcctcagatgtaaatatagagatataagttagctggtggcagtggtatgtgatttaggaagctaatatgccatatggcattatgtattaaacacttttgcacataggtaagatattaaagatccttgggctgggcgccatggctcacaccagtaatcccagcactttgggaggccgaggcaggcagatcatttgaggtcaggagttcaagacaagcctggacaacatggtgaaaccctgtctgtactaaaaaaataaaaaaattagccaggcgtgatggcggttgcctgtaatcccagcaactctggaggttgaggcaggagaatcacttgaacctgggagacagagggtgcagtgagccgagatcatgccactgcactccagcctgggtgacagggtgagaatctgtctcaaaaaaaaaaaaaaagtatttacctaactatatgaataaactattgaaataattaaattatccataagtataaaatgaaataaacactaattatctgttctctctctctgtctcccttcctccatccctccctctctcatctgtgttgccctgtgctaaattatttccccaaactatgagtccatatatataggttctttttcaccttactcgaggctgcagctattatctcctgtttcagtcatttattccttctgtcccattttgacttcaaagctactaggggcacaaaaaaaaaaagagataattaagtttattagaattacctctttaatcaaagcaaaatttttaaaaaatctccaaaaaaggatttggaaattcatttcataatgaaatataagtaagctttggatttcatgaaccttaaaaaatcaattttgggaatcgagaggccttttgttctactccattcctgactcttggctgtgttgcaggtaaattaaaatgatatccatctgacctctgaataaataaagtgccactgtgtgtatagaaatggttatatttaatattattttcccaaaataatatattttgccaggttataactttgcaaaatatggtaatagtcactgaagaaaaccatttttctcttaccaaagattacgctcaattcttttttaaaagttttgtgaatttaatgacaccttaggcttaatgtgctctactttacaatccagatagtttctcctaaaatagcttgttctctgtcaatgttccaggaaataatagtcattgtattatcctatggcaaggattccaatataaaattgttctattctgtccagaaaatttacaagttttaactctaaaaactcatattgacacaatcaattttcactccattttagatcatatattttgaaaaggtaattaactgagaacttggatatgactgttcctccccacaatctccttgtaaaagcagctacaacagaaataaagtattttaccaaataaaaaataaattttttttcacttctcaaaacttttcagaatacaaatttaattggcttatattatatccagaccaattatttcttaaataataattaactaaaatgatgaacgttagagtcttttgtcaatcacaaataattatgttaattattagtcattatgatcactgggaaataaagaatgtgaaaaaagcatgcataataacattaacgcattttgttaagtttttgatcttgatgcattgtttacaattatgaaaaggacagaaaatgtaatacttctgttttgaattaatttttggattccaaatatcatcaggaaatgatactattatgagttctttatatcaccaaaacaaacaaaaacagattcaaatccagaggatgaaaatatttatacacaagaaaataccattttggtacctttattatttgtaagtgttaacgttgaacaatgttagacaaatgtcgtgataccctaattctactcttttttgtgtattttgtcttgtttttgctcctcacatgtgacaaaataaattcaagaatgttattccagtggataactgttatggggccagtactgcttgccgaacaggccatacatataggaggtgatggttttcatgctttctcttcctcattctgaaacttcaagcaaccaatatagaaacttagcaggaatggtattccttcatgtaaataaatttatctaagttggtggtttacggacattgtatttcataggtcaataacaacattacaaaaaaaaaaaactattagggaacatcacaaaagttctgccctttactttttctagtaaaggacattgtaacaaaatgagaagaaagaaaaagaaaggccattttaatacctccaaaactgttgaaacccataattttgaaagaaaggacaattcttgcattaaaaaactttgctttatgaaaagctaaataaaaaattgctcttttttttcttttccttatggaccattgaaaacttctggaccatggcagactggcattaggataccactgacataaaaatacagaacaaccaactctgaaactgcagggatttccacaggaagatgttatacattcattcattcaatcattcattccacatactttcattaaatacctgctctgtgatagactctatgtcttggggaaacagtgactaacaagatagaataggctcctgacttcatcaagcctacattctaatgatagcagacaaattataaacaagtaaacatgcaaaggtaacatttgcagattgcagtaaatattagaagggaaacgtctagctgatgttctagagcatgatggtaaggatagaatggatgtggcgaacgacataaaataggttgtcgaaggcaggccacctgtggagataatgttcactctgcatcctgcaatgtgacgggagaccagcaaggaaatatccagaaatagaggcccaagtcaaaggaaacataattgcaatgacctgaggtagaagacatcttggcaagtttaaagaagaggagggctttgtagcagattaaagagaccctttcccattagggaggccaatatatgaagaggactagatctcttaattttccacatatgaaatactcgagtgtatctacgaagcaagaaatgaaaatatagtgaccgatattattcatgtttcatgtgtgtttatgattgtctagatactaaccagttaacacattttgagctttatacgggtcacagatggagttatatgttatagataactgtatttgttaggtaattcatttatttttcatcacccagatagtctattaactaagaaagcactaattattatggaaaattatggaccttctggaactttccccagttaatttattctggcgagaagtgcccatgcactgatatccagaaaaacagttaacaatgcctccaaattatctgaacatcttaagtttgtacagatatgggcacttggattatatttaatccatgcatctttcatccatggattagtcaccactaaatatagctttcctctgttttacatgcgttaaaatagctatttaggaattttaaaaactgctcatgattatagcatatggtgctaaatttgagaatgcaatcaattcggacttccatttagttctcttggctgttactaaatgggtgctaaactatactcaaaagattaaataaagggtaaaaatgatagaatgtttttaagcaaaattatgttataacatcaaggctatgtgaatttgtattattcataaaactaaattttaaacaaaccttaattatttcaaaagcaactggatcataaaggagggcaggagaattatcagataacttaccaacttgaaaatattataatccttttattttgtgaaaatcaaagtggaaaacaatatacacttgaatagattttattcatctgttctcagaatatgttccatacaatgagagtcttaagtaatcattgaagaatcagaatgattcacagatggtgcaagtgatttaattatttttaaccagttgttctggacatgctcagaaggatatttccaaccccactgcagaagccatctgagctcccttccagctggtgttccatattttcaaagcaaatttagattggagaaaattacactttatattgttgtgttgcaaacggaggtcaaattgctgtgtataaattcttgttcttttttttcttcattgtatgagttatatttatcaaatatcacgtcttttgtatgattgctatggatttgccaatggtattttacgttttgtgttgtctggcacttaggaggcactagataaatgtttattcaatgaaagaaataccaattcagtgtattcaaaataaaacttgaatttatttctagactcacactaagtgtatggagttaccatttaactgcatcctcaccattattgggaggttcccattaaaaatgaacaaaaaaaggaagaaaccaatgtaataaaacaataccacgatcactacccccatcatcaaagaaaatcatcaacaaaactctgtgttaattcaataagtaaaactacatcttgatgctggaaccctgtcccctaattttataggatcttaggaaacctgcttgacaaattttcacctttttaggctatcataaggataagagataccctttgtaaaaatttagtcttgcatacttcataatgcggaatgactgtaacatcagtcaagaaacataactgatatctgtaatcatttccactatgctaagaaaagggaatggaaggaatatgggcatcccattaatgtccatagtcacaatgagaagtaacaaactgttcccaaatagttctatcaaatgtaataatttttcaaggttgtagcattcaaataaagataatactaactttagtgaaccaagtttcctcatctgatgctaaaaatgagttatatttttttaattttatcagtaacattatatgatagtaaaactgcacatatcaataattcatcacttcattttgtatttatatccaatatttctgaaaaatatattaatcatagattttgcagtcaatatttcctgaagaatgtgctaaatttccacttgatagaaaaatttgacacagtatattactatgttttttcttatgtttattaatatatttgacaacacattgcatgatgactgtagtctattactgtaacattaattcagaagataagcaaatataaaattgtatatctaacagagccataatctaactataaaataattgtgaatagtaagtgtagcttgacacatttattctactatttttatttaacgtgctacttgaagccagtcatttgagacaatattcaagaggtaatatgttgtataaatcacgtataaatggtaaatttgcttaaacttacaagaatattaaactgtaattaacatcttattttatacatagtgatggctttggactagagatattcggaaaacacaaaatcctatgttcatatagtttcttactacccttgatgaattcaattaatgttcttaaacctcagttttctatttggattatttgctttaacttaatagcttgtctttatttttccctctactattcaaaaattgtatacttctatcgatttaatgattagtataaaattcttaacacgcacaagaaattttgcaagttttcattctaagcactaagagaatcttaaaattgctttattcattattgattaattacttattttatgaattaaacaaatatatactgtgtacctagtcactgttttgggtgttgaggacacagcagtgggaaaaaaagacaatttttttttgcattgttgggttggagctctacttctaggtagggaaataaatactcaagaagataaagaaggaaaatattgagaactttcctggtcatgcactttattgagaaaaataaatgaggaaagcatggataaaaagtgtgtgtgtgtgtgtgtgtgtgtgtgtgtggtgtatgtgcacacatgagaaagattcattgaaaaaaacacttttgagtaaagaagttaaggcagaaacgaaaagagccacatggagaaacgggggaggattattttaggcagaggtagcacacaatgcaatgggtgcatgtcagatctgtgaaagcagcagcaaaggggtcaacataggtggagcagaggaaagtattaagagataaggcctgagttaagaagtgggccagccaggtcagatatcccttgaaattcatgaagagttttggatttcacttaaaaatagatgggaattcattgaaggattatgatcagatttaaatatggtttatatttttcaaatgttgtccctgtgtattgtgtagagataggctaaagaaagcatgcgtagatttttttttttctctgaaaatttgaaagaacggtgcttccactgcatttgaggggaaaagaataattttgttttaatcaagtcacgaggctggatgaaaacagcaagacatatatagaataaataaaaatggcaagtgcccaaggactgagcactgaggcatttcagcattagagaagtaggtactacctatggaaactgagaaacaatacatagaaaggtagcaggtaaactggatgaaaaacttaaccaccttctcatgtttcattgatgtccagcatttttctgttttttaatagacactttcatacacggtaaatgtttatttaagacttttccatttttttaccattttctttgcacatcattttcttttgcagcttaaatcttccatcttgtatctttctcctgcttaaagaccaatcttgacgtcctctaaagggaattttatgctagtaaacggtttctgtgtgtctgaaaagatctttatttcaatgttattcctgaaagagagtttctatcagtacacaattctaggttcctacgtggatgttctttcattgtttttgaaaatattattctaccgtcttctggcttctatcattgctctaaaaccaggtaccattttaagtgtcactactttctaaggaaatacagcagtatttaaaattatttctttgctttttttggattcatcagattcatcgtctcatagtgatgatctatacttatatttcttttttttaataatcttttctgcttcagatttgctcagtttcccaatcggagtattggaatttctattaagttttgaaaatcctaagctattatcactacagataatgcctcttctccattgtgggtaggatttatttattcccctttacagctgagggaagcccttgaaaattcagactttaaggaggggttttattttcacctctatattatgtgttgttgaaggtcacatattttgtcctaaaaggtcttgaaaacttcttcctagccattaggctctcaatccaggttcagtttcacgtaagatgatttgatcattcatggcacacagagggaagagaggttccaccatagcccagctgtgtatttaaaacttttaaaaattatattttattcagaatttccacgcatttgaagtgagggggtgaggaattaagtcagtctgtcatctttctggaagctgatactcgctgaacatgcctctacttaaccattaaactgattatgctacacaactagacactagaacaaaaaaactccgtacaaatatttataaccactatgatcatcaacaatctagaaaaacataaaatgttagctaatttcttttttaatccttgtaatatgttaattacaaaattgagctgagaggagaaaaattctacaaacagctacatcctggtgcaacatttcccttaacaaccattattagtcttttgtatttacaattccatttgctaaagaacattctgtctctaaataagaaaatcatttatcttcccaaattctccaaggatgttgcactggcagctgacaatctttgttgttatttcaaggcaaagaagaaaatctatgtggcaattatgcaaagacaatatatttcccctaattttattctcaaaatgagttgcttttattacaagataggagacaatataaaaaatgtgtagcagaccattaaatctaggctcagacattattttacataaggtggtggcaaacagttctgttattacttttcttgtacatctctgcttaaatttaaggaaatcccaaacaacagaagaataatgatacggtgatgttcttcccatttttttctaaagaatattcttatttcaccatcactcaaataagaaacctttcatcaatctgaaatcaaatttcccttttctactgcaactgtctagatgtgaaagtctatagaatctaaccccttcatagaaagtcataatcccattagcatatcaaacgcactagaaagttatagagtaaggaaagtttgcttaatctactgtttaccaaaattgtttaaacactgaaacttttttccttttttattaataactcccaccatgttttggaaagcagtgagttcaagtttggcgtcttccatttctcagatgtatccttggacaaatctcttaacctcatttatgctaatttttcttacagtaaaatgacaaagaaaatgatacttgagagggtcattactgtgatcaaactagatgcatgtgaaaactctttgtgaatgtataatactattcagattcaaacaacttaaaaaagttagtggaaaaatattcacaatatataggtgtttattttacaaatttattcaattaaggactacttttttttcttgaggcggggtctcaatctgttgcccaggctgtagtgcagtggtgtgatccctgctgactgtaacctctgtctcccagtttcaagcaattctcatgcctcagcctctgagaagcttggattacaagcaactgccagcaagcctggctaattttatatataaaacatatataatacatatatataacatatatatataacttgtatatatatgttatatatggatgtatatatgtatatacatgtatatataacatgtatttataacatttatatatacatgttatatatataacatgtgtatgttatatataaaacatgttatatataacgtgtatatgttatataacatgttatatacataacatgtgtatgttatatataaaacattataaaacaaacatgttatatacataacatatacataacatgttatatacataacatatacataatatgtatatataacatataacatgttatatacataacatgtatatataacatgtatatacgtagaacatgtgtatataggcataacatgtatatataaaacgttatatatgtataacatgttatatataacacgtgtatatatgtataacatgttatatataacgtgcatatataacatgttatattcaacgttatatgtgtataacatgttatatataacatgttatacatataacgtgtatatatgtatgttatatataacgtgtatacgtgtatgttatatataacgtgtatatgtgtataacatgttatatataacgtgtatatataacgttatatataacgtgtatatataacgttatatataacgtgtatatataacgttatatataacgtgtgtataacatgttatatataacgtgtgtatacgtacatgttatatatgttatatgtaacatgtgcatacgtgtataacatgttatctgtgtgtgtataacatgtgtatatatgtatagcatgtcatatatatacatgacatgttatatatgttagccaggctgatctggaactcctcctcaagtgatccgcccacctcggcctcacaaagagctgggattacagttgtgagccaccacgcccagccaaggactattttaaataacacatttattgcagcatttaatctacaaacaaggttaattttctatcagccttccaagagcatgtatattttggaaatgtgtactttaattttgtcaaaatatcccattacaattactctgctgtaggacaagctatccattgcaatacaatattgtaaccctcttcatattcatcttttaccacctcacttttatgttccagaagctgtgtctttccttagtatgcctacttctagaagtaaccgtaagagaaactgatgttctgaacgagcagtcttaaactccgaatttgcatacataagtatagggaatataaaacatttataacagaaactactacattacataaccagattatacatcaaagttctactaaatattcattgttcctaaatgaaaggatatctaaataagttatagcacctatgcaaaattctaggtgaaaaatattccattagaaaaatatgttcaaagatactgatatggaaatgaaattggttgtgtttaagtatagaaaagaaacctttaggcctctatgttagcagaagagcaaaaagggagacaaagtgtgagtaacagaagtgataggaaggggctacatcatatagcggatcacaggatttcatttaaagagtaatgggcaggaggggcctgatatgatctcattaactccttagaaggagctctctgccttcaccaggagaaatatggtgtaagtggggaaagactggaagaagaggttagaggttgttgaagtaatccagatgagagataataatcttgtagattagcacttccataacagatacggaggagtgatttgatgcattttgcaggtatatccaacaagagtggaaataatttacatggtaatgtaagagaaaagaatcatgaaggatgtctaggtttctgacttaagtaaataatagtgcaatttaataacatctggagatgttggtagatgccaattaacgtagatggggggtggatcatttatttttcacttggctattgtatgtttgagatgctcattaggcatccaagataagagactgttggatataaaatgttaaacatcaagatcatatacttggtatttgatgtcataacatgctcagctcaagtggaaatgtatttagaaaatggacatttctttttcttcactgaagtgggcttttttttgtatttttttgctgctgttcttggaaaggtcatgtatgtatacatatttcagaggtttagcacttttttgctatctagaaacattataattggtaataatttacatagaacacattatgcacaagccttatatttgttgccattatctcgaataagtcttgtttttatctccctttacatagcatatgtaatatgcaggatatgaattaaggatatgtaattcataggatatgcaataagtcttctatttgatttctctctctttacacaggatcagtcaaacactgcattctcctagtattctgtgttttccttggtggcactgaccaaattttaggattataagcttttttaataaatgttcttatttacagagaaaacaattttatacagctttacatcgctgtctccttccttctagtttcattttattttacacaaatatattgcttagtaattattttagcaaaaatctatagacaagaaattcttagtttttgttcaggtgaaactagctgtatgtctgagaatattttgccttaattcttgaatcatgttttacctggtatttgaaaatgtgcctagcattttgaagatattattcaactgtcttctaatatctattgttgatgaaaagtcttcagtcaatattgtcatcctgtaaatgttcttttgtcttaagtaacccttaatgatacctttttgattactgatgctctgagtttcattcagagctagctggtagacttgtttttattttttccacgttggttgacctttattgaatttgaggattcattaaaatttacatttattccattttattaaatttcattaatatgaaatattgtctcttccccataatccctatttttttcaacttgaaacttatttcacgcagatgtttgagggattaattatattttcatttccagactttgttttttcaaatcttcgttttcactttatataatggcctattcttactggaaaaaaatccatttaatttttatttttgaacattaaaaattacttaatatcctttggtgattatcctcttatctctattttcttcaggtatacattctccttttaacgtttggcatctgataacattgcttataatttttttccacaataatcataattttagtttgtaagcttatgttccttagcagtttcacatgacccttgggggttgtagtggtatcttcattgtataattttgtgtttgcaaatgcctgggctctctgaggttattttccaaatgctacaatgatgtgaggggcagtttagggaaaatcatgccctttcttggcagtcatcagatttgtgtgatatttcctgtgtttattctgtgaatctagagaaaagtatctgcttatatattatagaattaaatttgaaattttcactgaacgagatatctgttgttaacattttaaacaaatgctgcgtacttaattctcttaatgacttatgaaaatattttaaaaattaaagattatgtctattttccaatgttaatatatatacagaaaggagacgaagaaaactttcatgcattgagcctgcataacgcagcaggtgtttgacaaatattaccttatttaatcctcagaaacatccttatctctattgtacagatgaagtaaatgagactcagtttatccctgatcatacagcactcaaagtcactgggattcatattcaaggctgtttatccaagagttaattttactagaccacactgctgtgatagtacatcctatagaactatcccttttcctcagtttacagtccgtgcttggtcttaactgaggaacctagtttctaaaccaacaggaaatatattagaaatgattggaattcctaattaaggcaggagttctctcattttgaatatctggtaaaatttttacctgcgtcctcccagtctcatgcctctttctttatcatctccaggtttgccctgaggaccacaatttgcagataccctctactatgctttggtctgcattcctgtgtggctgggcgctgcctcatgattgttccctcaaagtctcagtccttttctgagctttattactaccatatatagctctgacatggacagagtcccctaaatgccttaattttacagtggttagcacttctctgagtctttatctgtgagataaggaaaattaatttttcattttaaactcactcagctctcacatactaagcattttaagagtaccgcttactatttcaacatgttgctgtaaagacatgaaagatgaactttaagcctacagtttatatctagaaaaacaaaaagggacagttaggaaaagtaaaaatcaaacaattagagaaggagaatatagggggaggtaagaaattctgaagctatggcatatgctgcatcagagccattgtaaggttatatcaaatactacttttcattaagctgttactgtgactatcacaaatgactctagggcgtaagaattgggaaagataactctaatcagtggccacagtgaaattagttttaaaatgcattgacaattggtcaagtataaagatgtatcttgaatatttctacacccacctgtctatctatctacctaccaacctatatacctacttatcatctatcaattatccctcagttctaattaaaatacgatgccaaatataactgcaatattaaattgattattcttcatacagattgtgattactttattatcatggataattaagagttaacacaaaaatagcccccttcacattctgaattttggatctttaatatataaaacttaagaataaatcgtttatgaggaaaatatatcccagaattttactacaattttttaaaaatatatactggttcacacatgcttcctttatttcaccagtcattattacgttgtacaaatatttgttgagagcctactatgaatagggacataatggcattttaagtaagtggtttatggagatttttgatcctgtgcctatttagccataaagcattagcaacttgattagtttgtaacgaattttaaacctgcatattgggtgtgtcaagacctggggaaaattggaatggagaaatgagttagtagtcagataattcaaagcaaaggactcccccttgaatgatctattaaattgaggtgaaactattttattagaattttctttttgattgccttaatctttcgcttcattttgcatctgcagacacaggcttgctggttagtgtaaggttatttatgacacattacattcataacatctaatatgaaggataataggctgaaacattcagccaggtggaattagacttcacatgcaatacagtttcgctatttctcgtattcttccaattgctcagaataattcacctgctattaaactttagggtattagatttaacagaaaacagtgtatttattaattttcttgaagtattaaaagaagtcacaataatatgcaacatacttcccttatatgcttataaaattaagttatggtaactgcttttgacattttaaaaatatacaccaaattaaatggaactgacactatcacagaagaagttcccaagaagtctcatacatgggctgaaccctatgcagttattatttacatagggcaaaatggttgagtatctgtttgattcatataattcaacctaacttaactataaagacttagtttccagattttgacatcctggttttgtgaggagtactttcttctataattacagatgatgatcattcctcttcatcttacaagtgttaataataggaacaaaaatgtacctgtcagaaaacctctatggtttatacctactacaaataaagaagtgagaccaagctaacaattctgaatcgcctttttaaagagagaaccatacactttccattcagttgtttgaaagaagagcagtcactcctttttgttttggctggtaacatttcagtaataacattatctgatattgttcaatctgcaatcaattagcaaccatcttactaggcatccagttcttttatgggcactgtaacccattaagtagttaaaccaggtgtgaggattaagctattattcttcaagtcaatgagataatggcttatgcaggttgacataagatgtaccatgaaatatttattatttatcatgtatacattaagaaagtaaaatcagcatgggatgatctcaggaaagcaatacatattttttggattagacattgaagtaaagtgaatgtatgataaattgacaaattaacattgccaatgttatgaaaaatgatgtagcaaaaaaaattaagatgtattttcatttttgataaggggttttccctgttatctgttaatttcttgtgtctttaattggcaaaattaagcactagtgttacagaagcccaaagtgagggaaaccactcactttcagaatgtacattagaagtttaaaactgtacccagattttttgtctcttttttttttattagtaggcctctgttaatagagtagtagttgcaaacacatacgtgggtttgccagtaacaactcacaatttgtgcaaagttgagtcttcgaaactgagcaaatttgctctcaatttcccgccagcgcttgctgagctggatctgagttggctccactgccattgcggccccatcctcagacaagccctcagcttgcctacgcactgcattcagctcctctttcttcttctgcaattcccgatcaatttcctattgagcaaaaccaatacagggcccagggcagttagctaaccacatcaaccgacttgcaagcagcaaatacttctctcaaaatttcaaaggctgttgtccctttattgtcatcctttgaagtttacaaatatgaaaggcatgactgtcatcctcgctcaataacccaaatattatttcagttatcctttgaatgcttggttttagatattctaattaagtaaatattgaaattggtctaacattttctttcttctaaattcctctggtgtcttgggatttgaaacaatttggagtgataactcattatttattagggaccgtccacatagaatataatttagagggtaagtgaataagttatttatttcctttttaaaggtttgaggaactcaacagagaatgaagcaaaataaaaagtgtaaaataataacagaaaaaaacatatttagacaatatgcaaataaatctatagagagtgaacactgatgtgtgaagatgctctgatgaaatgaatgggctaacatgagtaagaagtcgtccatataccgataagtcattagttcatctggaacaaagatacacaaagtcaattacaattttaccagaaaacacatcacatttcttaaatcactttacatagtctaaaacattttattcattcaacattacgtcaattgaataacacttaatacaatacatttactgaaaacaacacacaatacaaggaaatgcatcaaatcaaagagaacgttaatagaaacaagaacatcaacattttaaatatgatcttcacaggttaattaaactgtataataaaatctggtattgacattctaaaacaacattacctttattttcctttcatctctgggctcaggtaggctggctaattttttttcaatgtcatccaagcatttcaggagatcatcagcctgcctcttgtactgataccactgatgagaaatttctagagccttttttcttctttgagacctcaaatcctgttcatggtgcagacattattaaaatatcaatatatatgtatagtgcacttctggctgcagttatttatcaaaataatttgcgtccctcatctttttgtacaacttaggttaaaatcatatttaaatgcaaaatatacaaagacataattaaattgcctatgcatgaggcgggacccatgtataggaagctaagaaacctgaataacacacttaaagtattttctcttagcatgttcaaacttgcttaaaaattttgtcacattcaattgactcttaatgagctaactgttgtgtagtttatgtgcaagagtttaatatacgaatacaattgacttaactagatacaaactcacaaacctagtgagtttgtatctgacttaaaataggtaaaattctaaaatgtatatctttagccttggggctcatcaacaaaactttatgtactcaaccaatatacattcatgtttttagaaatgcctacataagagtttcataggccattaatattttatgattagaaatataaagccattttagttgtcttataaactgttccaagctgtatgtgtagaagtgtcaccactgttcgtatattggtgaacataactaataaaaaattatgtgagataaatgcttctccttccaaggcttgcatagccacatttatcttactataccaaatcatgctctaaatgcaaaacaattaactatttgaaaaaagaaaacagcaagtgcatgctttcaaatcaatgtgataagactaatttaataaatcaacaatgggaggaaatcagtcatcatgctctttacaagcacactcaatatcttctgtgattaatagaattactcaaaatgccattttataattcatgggaacataagctctgcatgcagctttcatttctacagaaagtagcaattagggttttattcacaggtttaattcgagcgaaaaaataataaatatcagggaatttctaaaaatttcattccattggaaaattttgaccttctctaaaatatttcataaggaccagaattggaactatttgacaggtttaaaaagttattgaatatgttggtatagattggtttggcgagtagtgttgacgattttgattaatcacttatagcctgtatttgcaagaatgaactacatttcattatctagtttgtttaaaattgggaatttaaaccttgctgtactttatgttttatgttgaattttcaaaccttctgaggagtcagatcgaacgctgcttttttcaaaggtagcaagatacagccacgtgaattagagttgagccatgccttatttgtgacataactcacatctttgccaggagaaagggcttggtggtcatcaatctgaaacatctttcatttcctaagcacaaagtgatgtataatatgtaaaatatttagagatgtcatgtagatttctttagaggaatgccagatgaccattaaacactgctattcagtaggacacacaccatcatacgaccagtgtagatacttctgaaagcttgctcacagttggaagggtgtgagttacatagcgttccgattttctagacacattatggtgtgcttttgcactccctcgaggaagaggccttttctgtttactatatttatcagcagttaccttcagaacacctgctggccaattagactttccttgtggattccttgcaggcacaatattgtgtaattacattctcagcagtgtttatttggttgactatagggggaaaggttttattctcttatttgcatgtagaaagcagactccatctacctgctaggtggatccaccttcataactacatagctcaaaagagtgatttacaaggaaaagctcagcaattaaaagtattagaaaatcagccatgcatgcaaatagtgattattgcaaagcatatacaaaaaaaaagtttcacaaaactttccacatgtctagtctcaagaacttcctagatattattatagaaaaattaagtttatcctgctcttcctgcacaaaccagatgagtcacctggggacttgaagccatacactacactgcttaatatgaaagtagcagttcttattcaagggcactaagattattttttaggattcctacataaatgaaatttgactttgtagatagttgcaaagagtgactttcttaaaggcataataaagttttaaaaataaataaaagaatctagggcttattaaacaagtatcaggttaccaaaaaattggacctaatgcaagcaaaatcaattaagtaaagaaagcaggaataatggatacatgtagatcggttattctggcagttaggcaggtttttttcaatataaagtagctgataaaaataaagcacattagaaaattaaatgtataagtactatgaatgcattcccatctttcaattactacttagaaaaatatgtctttaaaaagccataacttttaagcaacacatcgttcaaaatcaaataccactcaaaaatgttaaataaagcatacacattgaacagaaaaagtgagtttctgatgactaagtctgaagcagattttattaatgcacattatattttaccctatatattaaaaaaaaaccacaggcaaggtatattataattttagctctaataccttgagagcattatgttttgtctgtaacagctgctgttttatctttatttcctctcgctttctctcatctgtgattctttgttgtaagttgtctcctctttgcaacaattcttttacagtaccctcattgtcttcattctgatcaaaaacaacaagtacagtcttcattttggtttttaaaaagctgtacattgttaacagagataataagacatgttatttaaacacacacaaaaatccaatttaaaactttcatggaatgctattataagatactgtgctcatagcctttcttttacatttggtacttgaggtttcaaaataagtttcctcccatctagttgtaaagaacacatttttaggggcacctgtagaaagatgggggagtgtggtacttcatcatgtcagacaagtcatgaattactgtgaaagtattcttttggcttttttagtgtagttctagaaattaaaacattagagaaatgagctaaagttatcatttataatgttaactgatccataaaggaatacagatgtgtatttgtgactgagataacagcaaatctgaaaatattaacacacaactacatgaaaatattttgatttaaatgtacactaattcctatctaataactcctgcttcatttctgaaacctaaatgctcaatattaataggagaaatatcaggatattaataaaaatcatgtgctaagttaccatcaaataatttctaaaatatgtcatatatgcatgttaatttaaatacgatcaaataatactaaaatatggactggaaaatggctttaaacattttcaatgggtattttgttcctttaggctgcaagaacaatatcttaattttctttacttagaaataaaatgttttgaataaatgctggtctaatatagtcgcatatatgaccatgtgatttttcacctttagttttctttctttcaactcagaatgtgaaaactttgtatcaagtagtctcacattgtaatggtactcaaggtacactgatgacataaggaaaacaaataataaatttcaaaagtcacaagtatttgtatgtgtgtattacaattcaaggaattagatgttatatatttaaatctataatgcataaacttcaacacgcaactgaggactgattcattttgtatgggggaaagggattatttttgtcagagactggtcaataatctaaagaaacatacggcataatatagacacattatatacttatcataatatagacacatcatatacttatagtctgtaaaagactttacttattttaaaaggtgttgtaaaagtctgtagcattttctagggctgaggacaaaaacaacaaaaaattaaaaaacccacttcacttctttccctataccagttgagggctctagggcagagttggggtcagcccaagaggtaatcagtactttttttcatcttggtgccctctagtttcttctttgacctgaagtagagattgctgtaactcagcaacttggaaagcctcttccgtctttccacaagctgagttggcaaggccaccaaaccccatacatggggagtattgattgaggcagctccaggaagtgggaactaagattggtgggaatagttctcctattgcttcacacacttattacctaaaatttatatattgtcttctgatgtcactttcaagcattgtctgagaaggctctagcactggtaattgtaaaggttaagaatgccacagaggtgatggcagtgaaagaggggaaaaaattgtgaaaaggaggatgaagagagaaaaaaaaagtcagttaataaggatgtgatgtacaaatattcaagccagagagaaatgtagtagatactttgaaattagttgggattgaaggagaatattctgaggttgggaagagcacacatggtcatatttctttactcccatgaaataagcagcatgaatttatacacattttagacatataatgtactaactaaacaactatttggtaaaacaactttgtgggaaattgtaataaataatgttcatattatgcattattctctcttcattgaaataaatgttatactaccaaaaacattgctgatacaaaatgtcagtcatctatgatagttgagtattttattaaatttttagtttattttatgattcgactcttttttccaattacattttgcccttgataagttcaaaagtaggtcaggtcaaaagaaaattgctgggctatttattagaaaccgtaagtgctcctatattaccataccatagtaattcagcatttgtaataaaaggccaagaatattctgcatttataaaattcattagaatcataaaatgtgtaatatgtgctctgaaaattcagttggagacttatctaagttctttccaaatatttatttccactcctagttcattcacacttttatcacaaccaatttaccatatctttattgaagtcttcctctttcagattcaccccctgctgaatttcagcctccagtggttcaagcaatttttgtatatctgagttaaactgctccaattccttcaaaggaatggaggcctaaaaaaaaagatagtgctactttaaatcaaaattactttttattagaaacataaaccaaaagaaatacatttattcaacctcctgttgctaaactaatcacatgcattatgtttccatattatgttttatgaagggttttgaaatacaactggaaaagtacctgaggatgcaaataaggagaaacatttcacatcaccagagctgaacatacatgcaagatagtacaattcatcatttggtgatatcaacaacagtcaatttacagatacatttgaatgggctaatttttaatattctaaagtcaaatttgaccttattttaaatattctgatataaatacatttgggtaaatatgtctcatcagaaattgcctcatttatcaagtaacagtaacctcaggtagaaatgcagaattgtcatcttatccttagaaaaactacatggcaatctgctcagatgttttaaatgacatttttagcacagcacaattgacaggcatgctcttctaagacaatgccattagcttgccttaggaacagtttggttggtgatgcaaataaattcaaacgaatgaacctaatatatttcacataaagaatctatgcttttcaaccttgtaaacatcagtttctttacttttgaactgataatgaccagtctaagaaaactttaaaatctcttgactttctaaacaaaacccttgaaaaggagtgataagtgaaaagacatggaaaatcaaatatatattcaaaaaagtgggcaaggtttagttattagattaaaattctgttaataaaatacattgatactctctcaatctttatgctgtatttctttccattaaaacactagaacatattttatatgggatagctcttgaaaacccatagatgacatacagaaatctgattttctttcagagctaaaacattttacttttgtaaaaccaattcaggaatgacccccgtgtcttttgccaagacgattacattcatcaagtttggtccccacctacccttctccagtcacattcccaggaagaggttgaatttttattagatggcaacttctggtgaacaatacggataagtgtagaagaaaaactaaatatctaaaggtaataatctgtcactattgaagaagtgaataatcaaattctattcatgatgacatgattctcatatgcaacatgaataaccacatatcttctaggtacttctacacacccctgaaagatttatgagataattttaagtgacctattacagtaccagtttttaaatcctaatgatcatttgccatttgaaatatcataagttatttgaaccagtatagattggtagtggtacaaacatgcttaaagtttcaatgtctgtattattagcaattacggtacaataaaatcatacactgtttagatgacggtaaaagtaaaaagattaacaacccttagaatcataactatacaattatcaatttggtgatattttatgttattaaatggttgttcacatttgctaatatttaatgaaagcaactatgttctatgtgattttgtgaatacataatgataatgttgaaaataacttttattgtgtacttggatgtcagaagaacataggtctatttacagtcagatttacctgttttattccaactgcttcttctctagctcatctctccatgaatttaacttctattaatttaagatacaattttctacgaatttaacaattttttatgccttccaagtcttcaccctaagctgttatctgacttttgaattcccatctagactctccaatagccagctgaattttcacctgaagtttcacattcctagtatggagcacattatctttcccgcaaactgcttacaatactaacttccctagttctcttaatggaagaccatttctctcagtcattcaggcgtaaaacgtaagtcatgctatttttgaacatctcactctaatgtctaataaatatcaagtaagtgtcaattgacttgctatgatccacttgctttgtattcccagagactccatcgttcctggtccttacacaaaactaaggcaataagctttgaaaagatgtaaaatctcctttcagtcaaaccagttccagcctgtgcccaatgatcagcttactatgtttcaaaaacctttctttcattatgctatttatttgctgaagaacctcctgcatctattgagtataaatagaataaagtccaacctccagcacagtagtcaaggcttctcctaatcttgccccaaagacttgccagccttatgtaagtgttcctaatatagacctttttttgcaggccatttggtgatcttctgttatgcctccttcaatgaccttagaatacttttcatcttctagtgaagaacataaacttctgtatgaaaatgcatagattgaatctgggctctaccatttactagctgagggaacttagacaagttatttatcctcattgaacctcagtttctttataacatggagataagatgaatatctacctcacagggctattactaagatcaaatatgttagaatggtgtctggtatataataaaagcttaataaatgttgactattattttctctcaaacttctatgtgtccatccaatataaatacatgctctataaatcttgggtcttattttgatcctctcaaaatcctaatcatccattggctcaggtcaagcccttcctcctttgaaatctatggttttaaaggataaaatacatgcttattgatataatgagtctttattttaccaagggatttgatgaaatcataacattgtaatggtgaacatggaggattttagattccagtttggtagagttacataatcctgaagaacaaaactacagattaatttatctgcggcaatataaaaagtgatatcacagccttgcatttagtttacagggtgcagttttttttttttaatcaggaattatttggagacagaaaaggcataccacagatacagtcagtggggtgtgttccctagacatcctatggagctgagtttctcatgttcaacctacagtcatttctggtacatagtaaatattcataagtaaatatttcctgaaaaaataaatgaacaaaagactaaaaattgagggccaaaatagacatttcaaggagcttttttagtgacatggaattttaaataacacaatttctatgtagaaatgtcaaaagacctgactggttagcattatatgagtatgtatattaactgctgcccaaatgctaagcaacatgataccaccaggtaaacacaaaaaagggggaagatgtaaaaagagctttgggagagactaccaaaaactgaagtgctaattattcaggcaagataatggaaacttagacttctttagttcaatgtgtagggtctaaattttccaatgaaagactaccgtgcattttgtttaaaaaaattaggaagattaagaatttgagtagttttattttgtgtagtttcaaagtgattaactaaaatcagtgggcaaaaattatttggagcctaaattttaggtttatataagaacaactgatgaggactgcaatttttttaaaaacactgattttcaagtaatgctaaatgtttataagcagagactagatgaggatgtattcagtcacattttaggaacaaaatccttttcacacagacattttcttaaaattttataaccttacagtaagttcttgtctctaaattcaagtagaacttttatagtagtgcagctcaatagaaatataatacatgccatatatgtaattttaaatattctagttgccatagtaaaaaacaaaaaacagataaaattaattttactgatttcactgagatgtccaaattattgtataaactcataatcaatacaaaaatatgaatattttacattttatattctcttcaaaacccacacatattttacacttatttataaatcttaacatggagtagccaaatttctaaagctcagtggccacatgtggttcatgaccaccttattaggcagtatagagctctattaaccattatactcataacattgtaaagaactaatatctcataattactttgaataaaatagtaatgttttgtttataacttgtggtgaatttagattattcttacgtcggtcttattatcttgcattatgtgttctgagtgaaattttcaggcagtcctcggggtataggaaaaattacgggagtgggattgacctgttatttcaggagtttctattctcatttatgtgtatctcagcttgtgttgcactgctttcttatagacaggaatataatattatttggctttcaaagatatatgcttgtctctctaaataaattttccatccttaaagttggcaatatgtcttatactactctattttccagtgaaaacactgccttttattttatacaggaaaaggtgcttattatatcaatcggtagttttagaactacctatatattaatttaatcaaccagtgaccaattttataaccaaaataagtttatcaaaccaattgttttagctatgttattggcaagatagcaccagccatttgacagccatatgattaatagtctttggacacaaagagatgaaaaaaattcattgcttttcttaagagttcactagttcagcattaggctatgcccattctaaaacagaaaacactttcccacccaattaaaattctacatgtcattccttggtcttccctgtctttgtaacttggaattcttatgcaactttataaaggaaacatgtaataagaaagcgtttataatttaacagctcattcttgagtcaccaaattttaaaacacaaagtatatcatgcctgcttttcaattcagaattatgataaattgtctaaaacagttgaaagcaatggctgataaatcatcttaattattgggtaagttacttctattgactttaaaggaaatagatgaccacaaaagaactggaatcacaattaaatcacacaatgttagacagtgcacacaaaataggttttagttatatagaaaataatcaaacaaaagttataatattgcatgagaaagtgtataccaagcataggttttggacacttttaattttttacttaccttttcattttaagagctttagcatgactgtgcagtcatacaaaatacatataaattagaagacagggaagtataataaatggataaatggacacataaagaagagacagagaaaccgagaaagacaacactttgttttccttgattttttaatgtttcaaattgcttaacaactattaattgtgctttgttggattatttaaggattaatgaaatttaaggctttgttgaagttttggcattaaagctgaattttataacaagttaacaaaggataacagactgaagaaaagcaagatcaattacaaactgattcattgtaaattgaaagcattcaaaattactcagatacactttattagttttaaaatgtaagctttccttggttaaatattactttggcatgcacagatacactagcataataacgactgtgtttacacagacagcaagtaaacatttgttaatctggactatggaatcttaataatcatgataaattaccactatattcaaatcacactaaaacctaaattgaaaataaataatccaagtgctacagattggtttaaaattgcttcaaatccatcagtctcctttttccattctgcagctttgaaaatttatttatcattacaatattgatatagaaaaataaagaattcatggaaaccaagatgaaaaatttcaaggacaagtaacacactatagtacagaaaagacagactactgatatgatatgaagagttatttcacatcattctatctgtagaggaaaagaacttacaaaaacaaataagtgtattggaaagatactacatctatgctagaagaaagattatttaaaatatggtttataaacttatttattctattattttaaaattattagagcaaacaagaaaatgtaagaaatattatttttaaattaaataaattgactccaaatagtgacatttcattggttgcattcttttgagaatagataaagtactggtttacctttaatgctttgataataaaaatgtgaaaatgtgactaatttgtgaggctaattagaggatattacccagtagatttcaattgattttgtatggatgaggttaatttcatgcttacacattttaaaactggatgcaaaatatattcgtgggtcaagaatctgcttcctactgtcgaccttttataaagtttaacttagaatattgccctatttcatgattacatgactttttggagtaggaaatgaattaaaagaggaaaacatttaactctaaaatgtatgggggagacagacaaaagtaaaaacataacactttaagcaattttgtattttaaactttcttttcatttacttaggttgttttccagttttatttcttccattcccccttccttcttccatttcttcctccctaccaccttttgttcttgtcatttttaatacaaaaagtataacgaaatcactgtatttgaagtgaaattgggtatgtttatactaacacatagtagaccaacaaaaactactttatgacataaatagaggcagtaaactatgctgagtcagtgtattgaagtggacaaagcaatggactgagatctagtatttgctaaccacactgtctaactgtgagaacttggtcaactcactgacactctcacaacctcctataaatatctgaaagtctctggtccaaagcaaaattgctttacatctactgacactgatcaggggactaattttcctttatcaaaggagaacaatcaagattcaccaaatagctttaattatttcaaatgttatgctaacaagacccagatagttttatcaaatgacactgctcaccaaactcaattacacatctactttaaaaatattttacatggttaccaaagggatttattagcgaagtttcaatggacttaaccttgttatagggataaccaattacacatgtggaaaaaataagctaacataagaattatgttgttaggttcatatttttctgattcattttagtaaaataaaatttgcagatattatacagtttgactagtgatctgttactattacctgaagatattagttgtaaatattacatatttaatgctctacaaattatgcaatatttacaagtcttcatctcagttttcatgtttttatagaaaattttactaaaaatgaatatctatatacctacaatgtacctacaaaaattaaaaaaattaaaatttaaagaatatatatagcaagaatactgttccaattaagatacaatattattttccatcataggtgttaagttataatacgatcagaaagagactgcaaaatatcaatgtatttgcattgataaatctgactacagaaaattaagctttaattaaaaattttcaatccaatacatcttcattggaccttctagatcacatttataaaatgcatcatttatttcccaccgaagtttaggagagccaaaataattaaatcactgcttaattattttccacacatagaaccatattttaagatagattaggcccaatcatgtgtttctttttcttatatattctacattacatgggaaggtcactgactctctcacagcctcctataaacttgtgaaagtctcttatccaaagaatgattacttttatatcttctgacactgaatggaagtaaaaaaaaaaaaaaaaaaaaaaaaaaacttggtaatttacaattattgcagcaatcaaacaatgaatatttaagtatttgatgcccgattgtccaaatctcatattacagttgtaatacatatatatagaaactgctacatgaattttagcagcaattttcaaggcctatatggaaattaaagaacatatgccagatatatcctatagcaaataagtcttagtaaaggatcaaagtcagagaaaataatttcacttttttctggttagtatcaatttcagaataaataatttaacatttcagctccttagaacagtgaagtatatctaaatctctagaaaaatacaatctaagcaaattttatgtagaaattacataatattttgtaaaaagtaaaataattgcctttattaatatgacacacctaaagtttgtttagtcaaaattattttgcagctaagtattacaacaataaaaatataacttgatgcatattttattattgaaattttttttaatttttatttttgagatggaatctcactctgtcgcccaggctggggtgcagtggtgcgatctcggctcactgcaacctccgcctcccgggttcaaacaatttccctcctcagcctcccaagtagctgggattacaggcgcccaccaccatgcccagctaatttttgtatttttagtagagaaggggatttgccatgttggccaggttgatcttcaactcctgacgtcaggtgatctgcctgcagcggcctcccaaagtgttgggattacaggcgtgagccaccgcaccaggcctattattggaatttatatgcagactttcctagtcaatcagagttaaatttggagtcatttttgaattcatcatcttcttgggtccttgtatgtaatgacttaactctaggctacctctaaatatctccgcagcagcagttctctaagcgtggtccctagaccttcagcatcaatctgacctagaaaaatgttagaaatgcaaactcttgtgctccactccagacctagtgagtcagaagctctgagtgtggggcccagcacactggttttaacaattcacccaagtgcatacaaaagatttactgatctagactgaaatttcctttccactcccatagctatccctttttttgaggtcatcagtgtatctcatctagactactgcaatagctcccgaacttcatgtcattattcagtggaattctcctcacaactatcactggactaatttctcaacagtgcatacacagatacacacacacacacacacacacacacacacacacacacagagcacatcaagaactcttcattgcatactgaattaagcatgaatgattagtctggctgtccatgacctcttcacactgtgtctagccataatcttcagccttatcatccacaactaagttttatcttccatgccctctactctgaaaactaaaggaactcactcttcattgaacacactgtatgctcctaagctttctcatatgtttatgccgaattgttacctcctctgtgttgctggagtgactgctaaactcacttaccatgcactcactctcaatctagtatccatgaacacatcttgccctatcatcaaacagtaagctccttgaatccatcgtattttacctagcaatagatccccctcactaccaaacactgttatcggaaaataatatatggttggtgagaattcatcctgattaatcccttttctcaagtcttcactcattagtgcttttagatatacctcaactagcatctctcccaaattgctgactccccttctccaacttggcttctagagggatggagaggggtagaactgtcataattaatatgaataaataatcagtttatttttgtcttcccatgccccttcctatacttttgtctcctatcaccttattttcccgatggtatccacttgccctcagccatgccactatactccgatgccctaaaacagagacagttgagacaaggagtctctcctcattgattctgtcaatttactcagggttctaatattatctctgattgactgttgcaattctgatcctctccattaaaactgccatttcctcacattgatttcacatagattacgaaaaaacacgcttttttcaaagtcattggatactcttaggtaaccttaataaaatgggaaaaggcagcatttttatgtattttaaggggcgtatgtgggacaaacataactccttagtagttcttaaattcatccacttcattatctttaaggctggtctttgtcatgaaaatagcaaagacacgattttctgactccagtcgattacagcagagaccacagaaaatcagcaattctttcatttttttccatcagtttttgtctcaaccccccagattcggccattcaagtgtaatatacgtaacgatggaaatacccattgatattaattatttttaaccatttcatatctatacactgattaatacattttaaatgcatgtttttacatatattacataatttgatcctcattacaatctttagattaaaataaaacaggcatcatctcccttattttgtagctagaaatgaggctctgagaggtaaagaggcatatccaaaatcactaagtagtaatgtgctcagctagtgctcaaagcaggtcttgtgtcttgaagttaaggactttttgctctcaccatactgctccttgctgaggccaaaattaacattacagagagctgcacttggacagtcaagtcctcagccaatctgaactgaggatccctttactcactgctttctgggcttcggaatttcttgtcatgaacagtcctggcaggagacatgggagtaccccactttgtattcttcaccaaatagtaaatctagacaccagtgaattttcagcataagttatttctctattcaagggctctttagagttatgttctaaaggctatactgaaattactgattacaaagagtctatgacctacccgtgttcaatccaaatctactttttttatcaccatagtattttttttccccaggttactcttccatgaaacttagacatagactcaaccatagaaaagccatattctaacctaatattatcctgtataacccctactataaagaaacctgattttgagatcaaaggctaccccctaaaacctccagcacttcagcacttccctactccagagcaaacacacacaagacattaaatgttttcaatttcttattgtaatcaacaaaagattactgaatagccaaattttagaacgagcagggatttatgaactaatctaatttagaaatttcaaaccatgttctatgagcataatttatacttcctgaattcaatcataggaaggagaaagataaaatggcagatatttcccccatctagtaactctattattttccaatttattaatttaattttaaataatatgattttaatattaaatatttaaatttaatactttattttaaataataatattttgggcaggataggttttcttttaaaaattgttagtctattttaacttcctcatcttacaaacaatgaaatggatatgcagaaaaatcacatattctggctactactgaaaaagttaggcctaaatctcaatcttctaaatccactgttttctctggtgagattaccttctaaatctattgttctctctgccgagatcatctcaccattatttgaacatccccatgaagatgaattagtgttaaacatattttatgattatactaagtattcatttctgtttgaaaacatgtatttcttaagcaaggatctttatacccttgtatcttctcaccacaatctctaacacaatggaagctcaatcccattagctgatgcaatgaatatataagcaaagtgtcagatatgctttatttctgtgtttttcatttcatcgtgataatagagcataattatctcttcagagccctaaaatggggtcattgttacactcagttgcctttactaatttagagaaaaacaaatactttgaaaagcaaacatgtgattattttgttaattaacatataattgaaaatctggggccaggcacagtggttcacgcttgtaatcccagcactttgagaggcccaggcaggaggatcacttgaggtcaggagttccagaccagcctggccaacgtggtgaaaccccgtctctgccaaaatacaaaaattagccaggtgtcacggcgcccgcccgtaatcccagctacttgggaggctgaggcaggagaatcacttgattccaggaggcagaggttgcagtgagctgaggttatgccacagcactccagcctgggcaacagagagagtctccaccacacacacacacacaaaataataataataataataataataataaatgaatattcactggaaatttcttatgccttatgtttctagggaaaataaaagaagttcatagagtggatcactttatgcatgatttccagaagtatacttacaaattcatgcagaatgtgaaatgaaaactcacaaacttgtcttggtcacaaacttgtattggctgggtctgtcacatctgtggtggagagcaaattctacccattttttaatatctgtgaaccacaatcttgtaacacaatttatccaaagataataccttattttctcttaaatattctatagcttagtgatttattaaaatgtgcatgtgtgtgtgtctatatcttagtaatgaagtagtagcattttttaaggattgaaataaatctccattcattgtcttgttattacataagccattgatatctttagaagtaaaaacaattgtctttgtaagtaacaatacattctttcaaaactttaatcaattttaagagcctgtcacatttttttgcaggtaataatgactgactcaaatatatatatttgtgacagttaactactaagttctctcatgctgtctctctccatatgtagagaatatagccttttaaaagtcaactatataaggtctctatgtatggagagagagagtacaagagaactaagtagttaactattaaaaataacttgcaatgaattaaggtaaactaacaactttttaatttgggaaggtgaattttgaagggtaactgtgtctcatgcatacaagctaaactatttagaatttatcatgtcacatttcacttattttgaaaactactttaaatatgtactattatataacatgatgagacactgtaatgccttagaaagtgcagcaattgtgaaaccatgctattactggttgcttatatctatcaaaatattttttgaaaatgttctatttttccaggaatcaatacttacctgacatactgcatcatattttctcataaatactccaatgtttttttcatttcagattatttctaacaattatctatatacctaaatacatatattgattttatatacatttttatgtttgaaagcatatcatatatattgaaatttatcaaactacagtatataaatttctaggtaattacttgcatttcaaatcttcccaaagagctgaaattctataacactatatttatacatttttgcaaactacttattaaataagactttctcttcatcaaatcatacacaaatataaagtctatcacgcaaaagttccatattccctggttcttcttaaacagtaatataaataggcatataaaattacaaaaattaggatatgtaagctttgcaatgatttgttttcatggcgtgatcatttcattatagcctaatgaattttgtcacagtgtctacaactagcaaaagcaagttaaacaaacacacttgcacaaccagtaaagaggtaaaaaaacaccctagaccgtgcagaagatgtacaagacctcattttggatatttgatccacattacatacaagcaatattgtatcagtactgcttttggcaaaatttatcggtagtgctttatgttgatggatgacttgtgtgcttttggttttatttatttttttggccttcagcatgctatttgttatttttttctgtaggtgacccctgaaagtacgtatgtaaactgcagcatagaatgcagtcctagaatatctatggcagcaaaagatgagagagaaaaagagacagagagagacagagagagacagagacggggaggagtggcgtttatctcccattataatcagtggtaaaatttccttaaatacattttggcattcattttccttttgaaaaccttgctgtggggtctacttgcccctttcagagtactgcgcaaccttcgcaagagaccatttagcacaagtttccaccttggagtagatcttcctacctttccagtcttaattctgtgtgaaatggctgcaaatcgatggttgagctctgagatttggggctctactaatttcctgcagtggtcaccgcggtttgccatcaagtttgctgcttggtcacgtgtagagtccacctttgggcgtatgtcattcagttctgcctttaaacgctatattccatgagcaagagataggacttgaagttagtaattaatgaaggtcaagatagaaaaagagagccaaacagagcgagtgagcaagtgagcgagaagagtgagaaagagagagagagaaagtaagaaaatgagagcaagcacatgcagaaaatacaaagggagataaaaccacaacttccataaaacaggactaaaatgaaaatgcgtgtgatttcagaaaaatagatcaccgtccttaagtttgatgcatgtctatttaaaatgtttatttagtccgaggaaggacagggatgttttcccaactatgttgttgcaactatcataatatattctatttagtcttattttattatatcgttactgaatttaatagttgtggaatgaactaagtatgtgctcaggaggtcaggtagctgaagaacacttttctattccttcctagcactttcaagttcctctttattacattgagtgtcataagaaaaaaagtgattttctaacacatacgaattttctgtcacatacagaggtactgaggaatgttcttcctgacctgccgggtcacagaggttgaagttaaataactcagaccctattattcaaaaagccttgaaggaaattcaccataagatgacatctctgactatacatcaagggataatgaagagcacaatacagatccacatcaaaataagcttcagacaatggcataaatgtgttttggggatagcctggaatgaatttatagtttttcattaaaggtatatcgtaatctgtggaaaatatcagaggcataaaaataaattgcatagaaagaaacataatttttgagttttctttaaatagtaaacaactaatcaataaatttatcaaacattgcagcaaaacaaaataaaaaatgtttattgaaaagagagctgttaaaattcaactctacctatttaattgggaaaagagacatcatcaaatagaaacaatgtagtgtctataaggtatatttgcgtattacacctctcatacccttttatcggaatcattttttaaagaaaagattaagttccccttgaaaaagaagacagggcatcctaacagtcagttttgagactaaaagaaagaacccaaagcctagtttacatgtagttaaaaatgaaaacctcagctttacataagcccaacattaagactaattaccaagatttggatatggcataggcaaaaaaatcagctgactggatttcaggtgttcattcagatgggctaaatgaatgatagtgtcagattgttctttgtgttagacacaagaatgtagtaccaccattgacaaaggcagaaatttgcaatatgatttcaaaataaatcttggaatatctttctgaacggagtttacattgggtataattaactgagtgatggatttgaacagaaagtcagattacagaactcttcaaaatcattcatttccattcaaagggggaaggaaggaaaaagggaaagataaaggaaggaagaaaggattgttttactcttattaagacgtccttagtatcttttaggacaaagatgattgaagtaactggtgtacaatttggacattacttttcatattttatttgctaccttaagcacgtcttctttttgctggggtttctttttctctgattcatccaaaagtgtgtcagcctgaatgatccactttgtgatgtggtccacattctggtcaaaagtttccatgtgtttctggtattccttaattgtacagagacataccatggcattattggttagacaatattcttaaagaatttttcctatgttctaaaatgtttaaaagacaacaataaagtttcattgagattagttttaagtggtattttcatatagaatattgcgtaaatataaagaaaaatatattaaaatattgttatagatattgaattaagagccagcatatacgtagaattgagaaattttcaaacacagaattgttactggtcacttatgtatctttttctcgtgacagagaagggtgtaaaagcttctagccttttctcttaccaacaaaagatttaaccactcttctgctcgggaggtgacagctatccagttactattcagaagactgagtttatcttccaccaacgtctccttcttgcccaaaactgttttcaaggcctctcctacctctgtgatactcttcaggtgcaccttctgtttctcaatctctttttgagtagcctgtgaaaaggagagcattgaccttcaagtaatgtcttgtagtcttaagatttaatgcttatgaaacggctttctgtatggttactatgattctgcaaggttttaaacctataactatgtattaatgaatcatgaaaaccataccatatatactgaagcttcattgttgggtaactatgaacatatatatgtacataagcataattcatgtcttatttttcattataaatatttaataaacatacatattgttcaactaaatatatttatatttatttaatttatacatgtagtggctaaaggcagatatttgaaaatccatccacaaataagaaactgcccttagaaaattctacagtatggtgctactgtatttctgcagcagggatttttttagccttttagtgccatggatctttttggcatctgttgaagcttaaaaacccattctcataataatgcttttaaatgcataaaacaaaatacataggattttaaatgaaaacaattatactgaaatacaatgtgcaacacattttttaaatatttgtgatgtagtaatacatgttttatttcctaatatgttaattaacaagatctagcatcaggtctttaggataatttcaatgtagtgatgacgagcataactggtatttttaagtatgtacaatgtctggaacacgttataaaagtatctgtcatttctattagtgacaaagtcatgggtatctctattgctggagtttgttgctcacattttaactgaaaaaactgcttacttttggttttaattgaatacaaataaagataaagttttcccccaatccaagttcacagaccttatttctatccacataccctagactaaaatctcctaagagaataccactatttcctaagaggtgatttataaaacatgaaaacaatcacatttaacatgaaaaaagatagagagtagtgatggaaaaagtgatcttagtacaaaggtttactacctgccctgcataaagcccctttcctggtacatggcacggctgacagacaatgtggccactcggcattccactgagtctgtgcctggttctttccctgcctgtctagttagccagctgtgggacattcacagagagctgagccagagcccaacagaccctttttctcctttctcaataaggttaacagatacagagactgtgattggcactcgagttgaaaagctatttgcgagtggagctgatgtcttaatcacagaaagccaaagcaaaacaaaatcattgagaaacagcaataacaggaaagtggagaaagtccagatacaaataatcaattaataaacacacaaggagcagctctgtaatgccagcctacatctaatttcttaagaaaaaaattacagtacaagagtaagaaattaggtataggctggcctcatagagtcactctcaacatgtcttttctatctttataatatacctaagtagtcctgtggctgtctttctgccacgccataaggtcctggtccactcgaaatcacttctcatactttctgttttggttttgcctttggcatcggataaacaggagaaataaatgaggaaacaatgtataaaaatttttatgcaagacaaaaacactgtttcttcaattctaagatatggttttatgtcacattttttcaataaaaacatgcctgaaattaaggtacttaatgccagatgaactcgacagctatcatgcatggggttcttcatatgtaggtgctatttgttgcacacaggtgagcttagcaattcataaaagcaatttcttcatttatcaatcgtaagtgttgcctgagctcctattatatgccagttactactgtagcagaatcatatgtaattctcctcaatatattctgggagattattagaagtctctcatttgggtagatacagaccctttagagcttaacttcagagtagacatagactagattttattccttttaatactttgacttcaaccttttgtagtatacaacctctacaaccatagatgttagccattgttactaggctctgtgggataaaacggtagagaagtccccatccttcaaaaacttatatccaagtatgagtttgtcaaagagatggacatatacgcaaatgagaattatctactttctatattccagtctactggcatctcgctgtagttgatttattcacaaaggtaacccttcacaaagttgaagcttaatttatatttggattactaattatctcttaataagtcttcataaagatgacactatattttagcatcaatgtaaaaagttattgtgtacatagattttgtttcttacatgacaagcaatgcaattaaaggcaatggaattttccaaaactcagaagagatcacaaaagttttgaacttaggggataatgttgcaggtagttcctgggtcacagaaaccattatgtgtcaacatctggccaaattcctccagctaatttaaacaatgtccagtgatgttcagttgatgggaacaaaataggaaatgtggactaatttctagtgccttcttaagttccacaaaattataaattaaaactaaaagatgttcaatttatcaccattatcaacttgtatttgaaaaaagcagtgatatgatggtggtttataactgctaatggtcaaaagtgattcacaggacaatttacactctgtaaaaaaagagacctagagttaaacttttatgtatgctattcaacaataaggaaccagtattcaatcatttgtatacatgctgttttgggttaggaaaaaatattgtgttaatttagtaggccttaaatttttccctcaaatgtgtttttaatcaaagatatgacttaagaaataagacttaaataagacttagcctttaaatactatgctgagcttgctttctggagatctgaaatactaattgaccaatgtatatcaggtgcctaatatccagtctgtactgtgctattcactgccagagatgaggaatgaggtaatctttgcaaacctcactctaatcatgcctacagtgtagctgcagaggaaagcttaaatgcaataaaacaatttgatatcatactagaaaaaaatcacatttttttttggaaacagatgagccatggctggaataagcatgaatgactacaagggaaaggtgacacttgaaggcggagtgtgcatgggatggtttggattgactaaagacaaagtacgaagcaacgagaaggtatgaaagttagaatacaaggctgccatagaggaacagggaattcttactgtaaactaaaagaatacatttgatgaggttgttgacgaaccattttctctggctctaatagtttcccacaacacaagaatgtctgcatcttcagatgtatggagaaccaacctagagctattgccttggccattgtctttatacctgtactcattcctctcaaagggagctccttatttatagggttggcgagatggaaagaaacagctgaaaagatatggcatttcctccttttcaaaagcatccgattctcagcatacatgccttcttctgccttgtgaggtgagaagtggagagggttctagaagatctactcttctgaaggagcaagttcaaattcaatgactaaattcactaaattataactcagacactttaggtttttcagtcatgtagtaatgtgattgctgctaggatcgattttagggctgaagaaaaagcaagattgtgtacactcagttttaacttgacctatgacatgattgtaagtccaccttcaggagattcaagagaaggtgaacgcaaactatatacttggcactaagggtttttatgatagaggggaaaatatctgacataagtaaaatccaattaaactataaattctcacaatgtctaacatattattttccatatgttactttgtaacatttgatagctccagtataaatagtccaaatactaagcactaacttccatgatttcaaacaaatttgctgtctacttcttagccataatttgtaaatgctactctaatttccttattataaaagaatgagtataatgagttaatttcttccagtgaagtcatgccccatgttgatgggaaggatgaagaatacattctgattcattccccatatctacaagtataattgcttgtagaaatttaaaaaggcatgttcggttcagggttcagctatcggctcacttcactgatacagtagcaagatggaaaaaccttctccattggtctctgctgattataccatcagcatttttcattatttttatttaatggtagaacggtaaaaattattggaaaaatcatctggtcctataggaacacctttacaaacatttcccttcaggggtaaagaaatgtagctcacttaacctctattctctcctccacccatttcgtattttcacaagttttccagtaccttccacagattttcttggaatttctcagggacttatattcttaagataacttctctgtctgatctcttttttccaccccctctttttaaacaaattttattatcttaagagtctcctgttctctagagcttatcttcaatcagcaccacatttatttacctacgtaccttaacatcatttccttatagattcctccctttactaggactcaattaaattcagacttattttagctattcctttctcttactcatgttccctgtaatatgaataaaaggctaactaaagcatccataaaaggcatcttgagaagtccccctacccaggtgaattctgcacttagtatttgcaaatattataccatttctgatcacagagaacaggagagggttctttcaccttttagctacgtaacatattcgtggaaagaaaaggaatacattgccatattactgcaattctaagatgtgcatttgtcacattttaaggattcggaaattgagatgtaacatacaattaaggtttaccttgaaagtggtagtgtttttttttttttttttaaattctcagcagctgtaatcatatcaatggtgcatcacacaatctaacatgtcttaaacatgaggaaatgagatgctaattgcttttacagcccccaaaattactctatcatggctagaggtttaggacatattttactattaggctaatgtgacagaataatataatgatacattcaaaaagaacataaagcattaaatagtggattctatagcaatgtgtattgactttttaataacactgtattgtttattaaagaagaatttcatgaaagcagaatgaactgaacagaaataacagctctaactataatgacagtgaatagtgactccaatggcatgtaacagatgttctattttctaagtaacagctgcttgatgcattcattgcaccaagttaatgatctgctagtgttatttcacttcacagataaattactctgctcactttaaaaaaaaaagatacgtaatttttcaggggaatgagagtataacagactttagagtaagtaatagttcttatatttttatagctaagaggaatgatgagttgaggcagttatccagataatctaggaccagaaaccagatctctttaaactgtgaaatcttactgttataaaaaatatatatacaagacatggttgactgagctgaatttaggctctcgtcagacagcttgaaattcgcggatcttgtatcacattatctagtgattctcaactttgctgaataagagagctagttagagttagaccaattaaatcagaatctctggaagtgggccccaaacattgggatacttttcaagtttctcgggtgattttgatgtgcaaccaatgttgaaaaccacaggcaaacagaaagatgcattctgagtttttattgagtgatagtcattaaattctaagagtgaactgaaagccaaaggataattgagcaaccaatgtttgttcttcctgaggttaaatattataaaactttgtttccaaaataaacgtgaaaaacacggtaatttgttaaacaagtggctatttagacatagattattctgcatttaacaccttcagttaaatttattaataccatttgtgtgcgtgtgtgtttgtgtgtgttcctctcaggcaactcttggcatactaagactactgttaataaaacaggcggtaggatgaacatactataggaccaaattttttttttccagaaaatcttattctaccatttgaactttcagatgacaccatggatatttaggggtttaatggaactaaattatttaactgagttggaatctttgatgcttaaaacaaaattagaaataaaatgttagtgattaaatcagaaaatcatatagattagactttgtcaaagcttgtatttcccaaacataatgatcttcagggaagtaaacctctaattaatcacatacatatttactttcctatggttatgttttcgtgatcaattcatatgctaaacaatattggccagtaatgggatgttcagattgatttacttacactcaactaatcagagtgatattaagatactaacaaacaatatttgaaatctaaaatcacaacagtggggacagactacagactgtagtaggtgatagatacacacgggttttcattttattattttaatgaggacttatattttctgcacttgaaatttagccatggtttgtttcatgcttattgtgaataagtagctttttgttattttaagcttagattactttaaaattactagaaaataagacttcttatgataatttggtatagtggaaaaaactgttgaaatcaggcatagtattacagttttgctatgtaccaggacttgtatttgttcatctataaaacgggaacatttgatcaggtgattatttatgtttgttataaaacttgtacaattttaaatgtaaatcagcatttttctcttctctcaagaactgctttgtcattataatttgcaactcttaatttgcaagttacgtttaaacagatatttcatgagtatgtcctatgtgtcaggcaatatcttatgtacatgggaaatatcagagaccaaaatacacattttccctgtccttttgctgaatgaattactattgcctacataacagtccaagagagtaggggttatcatgaaagctcaaggaacttgtgcagttccagtattcaaactcttcaggtgctagtaatctcctgtagattgccttgccatttccttccatcatctctattctacagctatcagtgtttgtcacctcagcctagaaaattccattaacagaaaaggaaaagtatctgaacatttatggggtgataaatatcactgtgatggctgcctcgtggcattgctgttgtctggaccatgcagctagctaggattgatccatatttttaaaaacttaacattaattttaccctctttaatactactctgattgaagggtgaatttaaaaatacagtgaaagggctatgtcgctgtaggaagttgcaattagcattaataatttaaattgtcaattttcatcatcaatcttttatctcatttgttaatattctcaaatggctttcctcctgtcattttaatttaaaaatttttctttaccttttaaacaatttggaatacttttaaaatatattctttttttctgtaactataatttggaaacatggtcacagggtaaggggacacaggacagttttcttacctgcagctgtcccttcagttaatcacccctgaccacatcctcactacttctggaagttctcccattctttctctgtgggatcattaagaattagaatacctaagacattcttgagttcgtaattctcttcaagtagatggtatctttaaacatcttaaattgtgtcacgcaccacccagtatcttttggaagggctatgcattctagtatctatggtttggaatatgttactatttaattctgagcaggaagaaaacttagatgaatcattctatttaggaaagaccaattctacaacgccactggcctatcaaaaggatcccagaaatgtcaaacctctgatactcattcaagaagaagacatggcaaaattctatggtcaaacagggtgctgcttctatattagctttcctctagttcaggagtttgaatatgttctgtgaatggccacatagtagttgttctaggctttgtgagccatgcagtctctgtcacaattactcaactctgctgttttagcacaaaagcagccagaaaaaataaacaaatataaattgatacacttcaatagtcttatgtacagacactgacatatgcatttttaataatttttatgtgtcctgaagtatctagttcttcttttgattttttccaaccatttacataaaaacaattttcagcccatgggctgtacaaaagaaggtggctgaatggattaggcctaccaattatagtttgcccatctctgctctcatttatctgactagttaatttgccttcctcttggtgagagagtctcttaggcattcttctctattaggaagctcaagaagttggctagaattgatatggcccctattaggtcagctcttttcatggttcccatggtaacattaatcctcatattgaggatcctggacccacatgactttgaaatccttaggagtgaatgactattacaaatgtaatcatggtcaccctatgaaagcaatcaacatccgttattttctgactttttaacaaaagccattcagactggtgtgagatggtatcttatttagggtttaattggcatctctctgatgattagtgatattgaagattttttaatatgctcattggccgcttgtatgtcttctttcgaggagtgtctattcacgttctttgtcctgtttttaatctgtttttttttaatttcttgttgacaagtttaagttccttatagattctggatattattcttttgtcagatgcaaagtttgcaaatattttctcccattcaggaggttatctgtttactgtgttgattgtttctttttctgtacagaagctttaatttaattaactctcatttgtcaatttttgtttttgttgcatttgtcattgaggtcttggtcataaattctttgcctaagccagtgtccagaagaacttttcctaggttttattctaggatttttagtagtttcagggcttacatttaagactttaatccatcttgagttaatttttgtatatggtgaaaggtaggggtccaggttcattcctctatatatggctagccagctatcctagcaatatttaatgaataaggtgtcccttctctgttgcttatttttgccaactttgtcaaaaatcagttggttgtaggtgtgcagctttatttctgagttctctattctgttccattgatctaggtgtctatatctgtaatagtattatgctgtttgcgttactacagctttgtagtatattttaagtggggcaatgtaatgccctcaactttgttcttttggcttaggattgctttagctgttcaggccctttcttggttccatatgaattttagaattgttacacaatacacccatgtaacaaacttgcacatgtaacccctgaatctaaagtaattttaaaaagaaagtaatcgagaaacagagaaagggatatggagctttttgcacagttttcttgtttacaaaaagggaaataagatcattttcagaggaccttcagttctgatgttacctcacccagtgacttacagatctgtcctctctaataacgattctctctgaatagaagtgttcttaaggatagaacagcactgctgccacacaaactgaccatacacaggctaacttttggttccactttgatgaaaattctcagttctcggtttgcgctattcattcccttgactctgctttcacaaggaaatcattgataagaatctgtcgatcatgcttcaatgtagataataaagaaaaaaaaagccacagaaacatcctctttaaaaactggaaagacaatgttccttattcatctcgctggaattaatctgctaggttcctgtcctgttgctcaatcagcaggagaatctttggccaatgcttaggcaaaccgaatgaacagtggccatgctcttttgaaaccaataatactcacgaagtgggtgttccttaattactaagcgttatcttacagaacctggctagtggagtttccaaaaggaaaaatcccaagcatttgcttttgtatgttttcttatgttcttatatgtgattttagacacacagaaagtataccaaatgtaatcattacttctgtatgcataactcatcttaaggaatgaaatattacaagtatcatttaagtgtcctgttcatatcccacccaattcttttgtctttcctcacagagatagctcttgttctgtattcagtttatattaattcccaaacatctttctgcttttactatatattatatataactaaataatgtatatttctacatattttatcctttgtgtaaatggtaacacactgcaacatttaaggtgtttccaattttactatatttctcaagaagcttgatttttataacatctctttcatcgttttaggcaaccttccccttcctttttaaagggcacagcattagaaaacaaatggtgaattgccccctaagcctatgccaagtttataaagaacataactgatcttttggccagtgtaagaaactcttctggccgggtgtggtgactcacacctgtaatcccagcactttgggaggccgaggcaggtggatgacctgaggtcaggagttcgagaccagcctgaccatcatggtgaaactccaactctaccgaaaacacaaaaaattagcagggtatggtggcaggtgtctgtaatcccagctacccgggaggctggggcaggagaactgcttgaacccaggaggttgcagtgagccgagatcgggccattgcactccaggatcggtgacaagagcaagactccatctcaaaataaataaataagaataaactctttctttcggtatctatttggtttccctacaagttggaataattcatctcaatgctagtagtacctctctgaaggtgcatggggctgacttaagtattgctcacacaatgatggttgtctcattttattaattctgtgtattttatggtaggcctaaatgatagttgtgatgggaccttattgagaattttggtggtactggaaaactgcttgcacatggactatggccctataaataggcgatgaaatactattaaattaattaaataacataatctagtaagaaatgaaggaacagcaagaatgcctggctgctttggtggtcaccaacatagtttatattatagacaatgcatcatctggggcctgcccacagccacggtaaggaggtgaaatgagtatagagaatccaattttttttttttctcataaaaacttaagtgttagatcattgtggaagggcttgatttgatatgacagggatttttgataaaccgcattggtgacatgaatacagtaagccagaccagattgcttttgattttaatgttagattcatttttctcagcttcgtaatgtaagaaaaactgaattgaactttaaatatgcttatacttttctaatttaggataggaaatttcctcgattatataacacggctagttaaaaaccaaaaccctaaaacttttgtgtcacatgaagactttatgaaatatatattactatagattagtaaaatctgtattgtttttaaggtgacttctgattctccaattggagcaatacttccaaattctttgctaattttgatcttgaaaagtgaattctagttttctcatatcacaggaaaaactagtacatttagactcagtattatcattaaccagtatattaattttcatcacactcagtacttgatacttcatgccccctataaaacattctcacttcaccttttaaatgccatcatcaagtaagagagtactactgagctttattttcaatagcttttacagctaaagtaatagcccaactgtgttttcaaataaatacattcactgagagattgatacaggttcctagagaagtcaacatattttgagttgtcgatggtgagttttctttcttcaattatgcttggcacgaaaaggctcaatagccaatttctctgtgactggttcaaacccaaaactctatgttagcaaaaatttttagctattgaagccttctagtactatgacatacacatgaatatgaagccctgctttccaattagatatagggccaagtatagaaatgtgttctcagttagaaacaatctggcttctttccaggaaaaagatacagaaaatttttttctgtattcagagaaaataaataaccttcaaatctctgatgtctaattctacttaaaagctcagttgcaggaaagcatattcacagaaggttacatgatgtgacaattacgtattgcatgcctgtataaaaatgtctcctataattcataaatatatacacccagtatgtatccatacaaaattaaaaattaataaaatagagaatctgaaaatctgaaaacaattgctagactactttagacttctgctccaatattttttcctctcatagaattgcttttcctgaatggccctttagcactaaatttttctttttcatggagccatgttggtagaaaaaaataaacattcttattgtttattataagaatatgaatcagcgtgttatcacctttatgaccctcccatttattttcttctggcactaagttctagcaaaaagctaacatactactagtaaagttaaaattattttaattattattttaataatttggaaactttgggtctcaaaaatatgtttacttcttggttttgtcttttaggaagcttggcgccaatttgtggctttaaaatgttccctgtccattccaccacccatgatacattgtggatatatttctatgcaagaattttttattatttatctactataattttccttttcctagttttccaatttatttaggcttctcaagttgtgccatatgtatctcttcaagccacactaaataatttttctggaatttaatatatattaaatataattaagatactttaagataaaactgatactatttaactatagtcaatgtacttgaaattatgctttgtttggataaactaaaggtcaaaaaatcacttcatgagtaattgacatttttatgtatttgaatatttgaaactagatgttcaaatactttcatacgaaaataaatataatgttcttgggtcaacagaactgggagaaattcagcagatataaattaaattgtctaaaaattttttaaaataataaaaaagaaattgactctagatattcaaatttgctgcagtcacattccaaatacttggaatgatcggcaactacatttaatgtattgcatttaaatgaatttaatttagtttttaaaaatgtgacatttatcttttgaaacagcagatgaaacttatagcttgaattaagctctccacctaccaagaaaccatgagaaatgagaatgtactcaatagtcacggggtttcatatatgagagtttgaattttatgttaaaatattagaatgattatcataaatgtgactggcttagatctgcagggcatatattcttttatgattgttatttttaaagaaataatgagaaccttccaaataaattggtaaaaaaaaaaaaaagttctgtaattcagatgcaaatgaatatactttatttgacaactaagagattttagagtatgtcattaacagcttagtgtttgaaaagatctagatagagtgataaattatctttattctataaagaaagaaaataaatgccagttttctaagctttttttttttcctactagatctcacagtagctttgctccttgacgttatgaaaaatactttccaggcagattcaacaagcagacaattctccagactattcaagccttctatatgagaaggataacctagaaacctctgcaaaggtcattaccttataacatttgaatgatttcatggtgaggctaatgcaaaaatacctcaagtaatatgtttgaatgataagaaaaaataaggctaatgtgagttttaacctgtatatactgtatcttccttgctatagtaatctcatgtatgatcctgaataactataattcaatatcttatctaacattacatttattctgaaagagaagaaaaacaatttaattccctactatttatttggaaatattttatgtaacaaaatatattactacttgttctctgaatctacataaagacagttttcagtttgggtctcatttatacgattgtaagtttttacataaggtattgaaaatttcccaactttgaataatctggatagccacattgaattaaaaataaagtataaacgtcttatacatctagttaatttggtaactttaaaacattaagtgggtgtaaatggcctaacacagtggcaaattttgaggtaaaacatgttatcaatatcagctattttctttatatcaacacactttcaggtaatctggtaatgaataaacagtaaaaaaaaaaatactaagctatgagtctcttgactaagttctaagcagcatgaaatgattggccatcagagaaagggcaagaatttaacggctaatgattacaggagtcgctgtgtcatttggtgatggaaatgatagcccctgcatagacaccttgagattctttctgaaatgcgactttggcaatatgctaatcttgcaagtcctgtccagcccaactgtcttcaatctctgtgtccttgccctcttcatggctgtgggattcatctgggcagtatggtcttaggcaagccagtacattataggatctcatctctggaccaattttcagactaatgacctatgtatttcttaaggtcttattcataatttactgaactctaaggaagcttttggagagactcctgctaaagcttaccattggttttatcatggtcctgaaaagcacagattaatttttaagaaagggaatatgaaacaatattaatatttataatgctattattgctacatgttaatacttccttacaaaatcatattatgtgttttcacgtatgttcaaaataaccttcagtgatataggttttacctttccccaggcaacttcagaatccaaattactaggcattccttcaactgctgatctctttgtcaattccatatctgtagctgccagccattctgtcaagacattcatttcctttcgcatcttacgggacaatttcaagcatttctccaactgttgctttctttctgttacctgaaaagaattataatgaaatgtaatttagtttactctttaattcaaatttcgttataaccacttatttggaacttttatatttctgttatttaaaataactattttcttacacgttttaaaataatattttataaaaatcatatattctgaatattaagagtgaataaaaactgtctagggcagatgacatcgtttgtccaaaagatagggtcttgtatgtcgtcatggtagaaaagaaacctatacgaatttttctctaagataatttatagccaaagtttatgataaatacaatgatataagtcaaactgaagataaaactcatttctcactgaaaacttactgtcatgtgtcaataatatggcaagaaggtttacaatcctctatatacaagtgagactagctcatgctggtaaggaatcaaaatgaagatagaagattaattctctcaaaaggtaaaagtatttgtgtaatacctagaattctcaactgtatcctcgttacatctttaaagtgtctcacatctgctcaaaaacaatacagtgaataggtcacttcctccttaaacataattttgccatccaatagggacaaaaagatgaatgtgaagacaatattcattcccattaatagaaaaactaattacttgatcctgtgctcctgttctcagtgtttgataccaacaccctcaaaagcaaattatccatattctcacataagaaatgaacaaatctgtatttctccaccaccttctcagatgtgcctatattttgttaagattttcagttggttggtttaataaaaatcccagcatctctttctactaaaggcagtcaaatcatcaacaaaagccagataaattacaatttcttaaaggcaaatcttcttgcctcacacatctttagattactcctctctactcctgaaagttccttgaacaaagaaaggtctcactaaatatgctttatgtattgaataaaggaatgaatgaagacttgcaaatcgttaattacaagttagaaaatataactggtagaatttacataaagagtttatactcttacaagttgctcctggttttcttttctttggtatgtgttttcacctttttttaaaaaaaacccttgtctgtcatgaagcctgggaatctgaacaatagatataaatatttggctctgcagaaacagcatgatggaatgtaagtatgttaggctctgcgatacgtagtggactctcgacttgagtatgatttttggcagaacacctcatttttctcaacacatctgtcaaatgggattactatacttattaatagaacacaggaatattgcgagggtaaaggcagacaacagtttgagagagcatgacatattgtaccacctcaatcccttcctttattctcattatttacctttagggatggttcaataaaaaactgtgcctgaatgtatagagcaaaagctttatttacatttattttactaccttacaggtaaataaaacatggacaagatttggcttttgttgctaagaaatctgaaaggtagactccagattaatttcaattgtaatggaattggttaaaacaataccaccaccacaagtgcgttatttgtgcattatgccctaagcccaataggcaccactgactgatacatatatttatgtcatatatatgtgtgtgtgtgtctatgtgtatgtgtgtgtacaaccaaaataagaatctatctataagcaagaaaaacacaaaagataaaaatatgtataaagcatctaaaatgctacaatcgaaataaatattctggaaccttgataacaattccaattccaaataataaaattccttattttctttaggagaggtgtgcgtacatttagaaaacatttagttgctgaggctgtaaattcattttttaaacagattttcccttctatttttttttttcctaagtaaaagcatctgcccttttgactgcaagaattttgtgttgtaggggtgtgtggggggtgagggaaaatatactttatggtgtgtttctatgcatatttttcctatgcattattggtagaaaaatgattccagattcaatatttcaaagaaattctatcttcccagagctaatgcagtattgatttttatttatttcattttgtttatttccagctaaatacatttttaaaaaacaggagacactgccatcttaaggaaaattgagttttatactttgtgtgtgtatgcgaggaatggatacgtttaacacaatgccacctgcagtaaaatgttttagtagtcattgtttcacgaagttaacaatgtatttaagggatgatattagtattgctatttatgtaaatttccataaaaatcagagcatagagaaataaaaaggggttataggtattattacatcaatggtgccagctttaatatctcttaataaattaattatattttctctccccactcatcaccatgtaagaatacagcaaaaaggtaagacaagaagaaagctctcctcaggaatgaaatggatcagcaccttgatcttgcactcccagactccacacttgcagaaatcaatttacctagtttattttattgtgttatggcagccagagctgattactccaaaaaggtaatgcatactcaattgtggcagacacaaccatataaattctgaagatggttaaaatagaagggttccttcttacataaaaagaataatgtaataacatttcctttgttgcctttgctttcattagacaaagctactgctgttgaaaatattttgagtcaaaatccagacaatatttttattctcaggcaaagaatataggacttacagcatttttataagatggtatttatacatgatcccttagtcacaaatgtttctacatcaatatttacttcaaaaataaatgtttggcctatgtttttgctgtattctgtgatactattaaagttaaatatgatttcttcatacacttttattttgctttaaggatattactatgtggcaaatggttagaataaacacaagctctcagatatgtattttcaggaataaatagggtttgacatcattacgagaatcattcatttctgaataataatcaactcagggcactattattcgtctaatgtcactttcattgctttaaattctaattgatttattctgttattttatgttaaatttactcttgcaatgatttcgtaaaaattcctatgacaaataaaaagcccacacacaaaaaacctctattttaaaaagtaaactgagaaactcccctttaccaaaacatatattttcttaatttaaaaaatactcatccatacattattttagtataaagtcacacaggtcaaattataaactgaaaatttgtaatttataactataacatacattcattttattaatttaaaatttataattacaaaaacaatatatctccagaactgaagctgtagcattaggattaatattagagattattcaatctctaatacatttgagactagagattactcagtccttcgtaattgatgttaaatatgaaataattggcatctataaaaattgataagcaccggaataaggtatcaagtgcagatacaatttttctgtctgtggtgatctttaaacaatgataaatttctctagaggatataaaggtatctcattccaaaggtaccttggtagaccaaatgaacagttgaaatgtattttatttcaagattatcataatgctttcccatcaattgagtatcagtgtttcttattttgaaacaaagtaggagaatcttttgtcataggatggcaacaaacttgtttaaaacataacaaatattaattagagggtttttaaaatataaaaacaagactatctaagaaaaatgattacttccagatttcaacttaattataaaatttactttctatggtaaggaattggcaactaatatcttgaagatataaccttcaatctactttcaggctgagatgcaagaaatatgcctctccttagctatttctcaaacatggacattcatatttctgtctaagatgaggtgacaattttatcagtgatgttgttctattcactaaagttgagaacctgagttgtaaaaatataactttttatcctccaagaaattcagttctttcagtcagaacgaaattaaaatgttagaagtccatttttggaaatactaagatatccgtttatggaaagatatcccatattcatggattggaataaataatattgttaagatgtctgtaccactcaaagcaatttacagacttaatgcaatccctattaaaattccagtgacatttttggcagatgtagaagaaagaatcccaaatttcattttgaacaacaaaagacccagaatagccaaagcaatcttaagccaaaagaacgaagctggaggtatcataattacctgattcaaaaatattctataatgctctagtaattaaaagagcaggatggtagtataaaaacagacatatagaccaaaggaacagaatagagagcccaataataaatccacatatttatgatcaactgatcaaccaaggggccgagaatacacaatgaaaaaaggacattctcttcaataaatggttctgagaaattggatatccaaatgcatgaaaatgcaattggacacttatctcacagcatataaaaaaccagttcaaaatggactcaagacttaaaacctgaacctataaaatgatttgaagaaaacaggaaaaagcttcctgacattgttctgggcaaacattttttttggatctgactcccaaagcacaggcaacaagaggaaaactagacgactgttatcgcatcaacctaaaaagcttctgctcagcaaaacaaacaatcaacagagtgaagagactacttactatcataatctatacagaatatttgagttgagcgaagtgagatggagagatataggcatcttgaattagcagtgaagtggagctggtcatgagactctgatcaggacaatgatacaaaaataattacagagacgtaggtcttaactggctatccatgctatcttattagccaagtgtggtagattttgcaagtcttggccatatagggaaataattactgtgtaatttttaaacttaatgtggtctctgtggaatatgttaacaacattagacctacatataaatagatacagtttataatatttaccagtcttcaagtcatcacaagtagatatatataatgaaaataaggaacacttacaactaagaaacccttttagagctatctgatggaccaggaaaaacctccctgagcgttacgtatttttcaatctgaataagcagagcctcactgattaattattgtttcttaatgagaattccacatcgaaatatgtgtatatgtttatctttgtgtatatgtgtacatatatatatatacgtatatgtgtgtatatatatacgtatacatatacatagagagagagaggtgtttagaattgctaagactctaatcatacataatttattgcccgttgctttacaatttataaggaaagtggaaagaagtgtttgtggtctcagcatgcacacacctttgctcccagctcattataatgcaatttcaaagctgttactctttcatcaagttctttgggattttccgtctgctttttctgtacaatctgacgtccagtctttatcaccatttccacttcagacttcacttcactcagacttttatacaagttctaagtttaaacataaaacaaaacatgataatcagtagagttaaattatttcataatattatgaacagaaataaatagagatccccttaattgctattccatgtttgaaattttaatagagtagcattttgcagcggtggtcaatatctagcttttgcattttctgttgatttaatatttctaattgtctacacacatgcatatatgtgtcatttgcagctattcttattaaacagagagttaatcatatatatgtgttttgtgatatatatatatttagttcttcaatcaaagaacataaatgtcaattctgaattttacatgacttctattttaaatgttggagttatataattctagccataaatttggatgaattaattcactcctacatcgggtatttattgagtggttactatcaatcagatagtatttgaatcactgggaagtcagtggtggccaaaacacacacattcactattgttctcatggtacttacatattagtaacattaaagcacctaaatttctacatcataatttcaatatatattgtatcatatataagaaagtaaggtccttttcaatgttaattaaattacacaactttattttcttaaaagtgctgatgaaaaccagatataaaaatattattgacaattcacatgtacatcacaaatataaagcacacacatacggtttcacaaaacataggttgctataaaaaagcatcataagacaagtgtcataactttggaagacagctatgttcacaattataccaccaacaccactccaacaccacttgatgtcttaattttgctttgtagttttcctagaaatatatgtctttgtatgtatgtggccatgtattcaaatatatgtacgtgtgtgtatatacgtatacacgtatatataatagtttacattatgtatctctgctttaatttgtttagtcataaatctgaactatcagtacttattttagtattaccaaaaaataaacctgacagtaggtaattgtttttatggaattagaacaaaaattgggtttaatttctcttttcagtttaaaagtaatgtctaaaaaaaagcattttgtaaaggctggacaattatctgatcaatgctacatgtatatttccatattaatcctctttgacaaatgatgttaacattccttcatcactaataattatgacttttgtctgagtttcccagatgatattatttacttcattttacttttttcttagaagatataaaaatatctgtgtatctggaaacactgaaattaattattatgttggaaatcaacgatgctaatttggaatcagagatttttctaaattatttactctctgaacttcaaaaaatataaatgctttattttgatgaagaaagttccctcaaggtaccgttagccattaacattgtttcattcaataggcaagtaaaatatttataaacaaaggggagaaatattatttatatttgtgttcatgaaagtaagacttttataaatagacaaacatgtcttgaaggcaagactatgattatggtatacaccacaaagcatcgtaaacaatgaaaaaactaaacagtgtaaggatattcttatgaaagaactgcttcaattggtcctgacatttaaaccagaaccagaaaccaattgagcaaatgccttgagcagtttcctttgtactgacgcagggcacagtcacagcttgacacaggtgagattgttttcagctcatatttactgttggatacattttataaggtaacattagagacctgtttctagaaaagaacgaaaagtgctcactttgcaaatattagtcatgaataaggcacttgggtcatttatgctttccttttttttttttttggcaaaatttaagatgggatatgttcccatatattcctatccttactcatctaatatcaactaactactttctatcatttctattccaagtttctttttgggggtgagaataattaaagtaattataccactaaaatgcagcttgaattatgaaaatatattatcgaataagaatacctcatatttttcacacataaatatatgtatttattttaagatatttgttaaaaagaaaaatatttccccattcatgatatgactacgatgtatctgaaggactctgtttttcattgatattatggagtagatgtagaaacaatacttaaaatatcaagtactaaatagacttgttttccctttaataacattctgtgttttcattttatgtgacttcccactctaatggccgatagtacatgtagagttataataatacttatgttactcgagtagatgcaatcatacctcagctttgttttcagaggaatcatctcagttggtgagtttccaataacagcaacataggacaccgttcaatattataaagtttaaatcagatttatactttaggctatttgtacctttccatgccttttaattcggtgttgtcttgaggcatttcactgtatatccagtactggtgtttaaaggaaagttattaaagtttggaataagagtacctgaattggaatcttgctttgccattcaccagctgtttgtccttaaattctctcaggtaatctgtagccttaagaattaaaggtgacttctgtatgtcacgtagtttacctggcatccattatttctgaagttgttaggattattgcaactactgttgttgttactatttttagattaatatatttcctttctagatttccatttaaaatatatttaaagaatcataaaaattaaacacaagcaacatccttttatattctgcacagttcttagcagaattatagactcaaaaaagacacacagaataggccacaatacatgtgccaatttttgttctcaatcttaaaattacatagtataattattatggttatctgaaaacaattctctcttataaaagagcagttacttcttaatgaggaaagtcaaggggtacctgcgtatttgccaccagaaatacataccacacaatgatttagctgtgactgtactacttcctgttccacactctttgtttccaatgcaggcaagtgcatcttcacttcatctaaaatcatcttactttcttgtagacgctgctcaaaattggctggtttctggaataatcgaaacttcatggagacatcttgtaattttttctgtaaggacagtgtaaaaaggcactgatttaattttgcctttcaaacaataactggtcctatttttattgatagatctgcctttatttctgaagatatacagaaaaataaaaacaaaataaagcagtatttttccattcatccaacacaggaaaacatacatttgggagaatgattcagtagttttttcttaatgttatactaaataaaaggtaatttattaacctattttatctttaaaatgtagagagcaaaacactcattgtttagacatcaaattatagttttcaaataatgtcctcaaatccaatcttgccaataatcaagttgtccaatatagactggagtataatgcccaacgaaaacacgttccttagtttctgaaataacatatacctgtgcaacatcaatctgagacaggactctttgggcagcctccttcccctgattatgtttcttcatttcttctaaactgatctcatgacttgtcaaatcagattggattttctgttgggaggatagcattattagtcagcatgctctacaaagaacaactaactttccaagaagacgaaattcagaaactctcctcaaccacctctaccatgtagcttcctttaaaatgaccgtaaattggccaagagtggtggttcacacctgtaatcctagcactttgggaggtcgaggcaggtggatcacctaaatagaattatcataaatattttttactttcataaattatccaagtgaaacgatttatttcttccctatgggattattatgaaaaaagcaataatcattttgagtcaatatcaactatttcagatatcattttcaataggtaatttatatattatatgtagaattgatatgttttatctttgaagtcacactcaaatcggaccaaagacatgatgttaatctgtaagattcagccaactgtgacagggatgagatataatgagaaaattgcatgtggaaaatactccttaattaccttctttttattttattttattttattttgtagaggcagagtcttgctatgtgacccagcctggtcccaaactcctggtcttaagcaattctcctgtctcagcctcccacagagctgtgattataggcgtgagccactgtgcctggccttagtgtagtctactcagtcattatgtgccatatttcagttaaatttcagggaagctatgaatctaagaaatggaagtcaaatgccccaaacaggtattgctatttgtctgatagatatttgatggcttccggcagatactgattgtgaattttagataactataaaacatttcaatatttatatattcaataaagacattttcgatcaagttctatagtaaagtatattctgcatttaacatatgaatttctgagccagttataggcagggatctctgcagcatgtggacacgaacacaatacatttatttatttatttctgtcaaatccatacaaaatcagctagcggtcaaatcattctaatttaaaattcagtcattattagattattataatttagagcagaaactaaattataccagagtgcccataacattatcatgcagatcattttgcataacgtatattagtgtaagtgaatttacaccaattggagtaaattctgatacatatcattagaagataacatcagttttgcttagcagtttccagagcgaactatagccctgaactgagtaatgagaattataccaagaacatggactaagtggttaaggagctccttatgcaaggttataaattcacagatgtacctcaatattattccttagaatattaatcctaacaattatagaggcaaatcaattatgaattacctaaatagttagaattctgccttaaaacaaatgagagcaaatacgcatataaatgtatcttattttattaccatatcgatgatcttcattggttgaataactaccttgtgtgagaaatattgatatgtttcgtgaacctagaatctgggagtagggatccatctaggtgcatgacgttatttatagagcaagaaacatcacagaatctataaaattggatggaagtatgcagggtggagtgatgcttgtacggaggatgtcataagggagttgatgttaaagtagaactttcaataattagtaagcattgctgggagtaacagatgctttagaggggttatggctagggcctttcatcttggaaatgttaatcctcctcaaaaaggtgggccagtaacaaccatgtctgtgccacgtaattctggccaactccatgttatgggtgatcagaatacacacaatgcttgtgttaagagagaatcatcagaatctctctcagaaaattagaattgacagaagagtctggtcaaactgtgagtgcttcgaattgtgtcacatatactagcaaattgtgcttacgaagtccctagtttgcagagtggattgaggaagagcaaaggtccatgaacagagagagaagaaagaagtagatgcatagggagtgaggtggtaacaaaaacactgatggcttccaatgcggtatggctttatttatttatttagttagttatttatgttttgagatggaatctcgctctgtcacccaggctggaacgcaatagcacgatcttggctcactgcaacctccgcctcccaggttcaagcgattctcctgcctcagccaaccaagtagctgcgattacaggtgcccaccaccatgctcagctaatttttatattttttagtagcgacagggttttaccatgttggtcaggatggtctcgaatgcctgacctcaggtgatccacctgcctcggcttcccaaagtgctgggattacaggtgtgagccaccgtgcccagcccgtagatagcattttcgaaagagggctgcaataatagctcccacagcacatgctcctcttaccactccctcaacaagaggtgaagtttatttcttcagctctttaaatctgggttgactctttgactgctttgaccaatagaatatagtccaagtgccagttatggcaaaagtccttaagtggcctggcagcttccacgtctatctttttagaacagtcattcttagggtgctcccttttagaatccatccaacatattatgctctgagaaagctaagtaacatcgaaaggccatggataagtgcttcagcaacaatcacaacaaggctttcagccaacaactgctaggcatgtgaatgagtgatcttggacgttcagcccagttgagcattcaggttactatagtatcagacaacaatggactaaaatcacataagaaaccacaaaagagaaccatccaggtgagctttctcaacacgcaaaaccattagtgggaataataaatggctatcataaataaccaaaacacaggcattagtcccttcttgagtcaaaactttattactgcccttggattctatgacacattcctgtttccatatgaaaaacctttctctctcatttgttttgctttagttacttcaattttgttacttctaaatgagagtcctaaatactgtatatgcatactggatacgcaaggatataggagttgtaaaaacaaaagcatttctggttgaagagagacaaggtgtggagacagggcactgaagagcataaggagtttggcaaaatttaacaagaaatgtaggtagaaatcaggtattaaataactttatgtcccaaatgaatggttaccactattttgatcacgaagataaatttcaaaatttgaaattgatcataatcacagataacagtagttttattgctaatatttgatccgataactaaggaaattcatagggaggaaatgcgactgtaaatcagcagtatgttgaagtgagtttgcattttaataatcactatgtgtgtctgtacagagagaaagagggaaacagggtacatttgtataatatgtattttttcagtgttttcaagcgttagaggaaagcagaaagagagaacaaagagagaaccatggagaacacaaatttaactgacatggaaagaaaagcaccaaataaagagaaagaacagtcaaagagaaagaaaagaagaactagaaaagagagaaaatctcacatcaattgatgtgagaattttaagaatgagagagagaggtcaacagtgacagtttgagataggttcaatgggatcaatagtaatcagggtacatgagctcgtcaatgaccattgcagctagaagagagaagtggatgacgagagcagaaatcgtattttcaagggctggcctgattaaggatcaaggagcactctaataaaaatagtttaaattacttttgcagacttttgtctccacacataataaaattcaggtcaatcagacttgaacatactttaaggctacatgaaagaagccaacacataaagtgattttttttaaatgtaagaagataaacttgattttaaaaaaacctgtttaaagcaagaaaaccagagtgaagcacaaagctcagggccaacggaaaatatcaacaggaggagaggtggctctttttcagaaaacaaaagtaagatgtgaagacgcaagaagttgaatgcttcctacatggtgctctcagagtatcagggtgaaatcatgttaacagtaaccaggatttaaatttcagggctctctcttgccaccttgggcaaagcatcaacatgttctgaaccttgattttctcatgtctagcccaagaatgataatagcaagccagcaatgaagttttcttatctgagaaattctcatttcttcagtagtcaactacattggttttggtcaaaaagatcagatgtgacagtatatgtaaaaatacctgtccatgttatttgcacaaatatttagttataagttatcagcgatataacatgtcatttcctcgtaagcacaaaaccctaggtatctgctgaggatgagaggagagaatcaaggtggaatttaaatcaaagtgataaaagttcaatagcaattgtggagactgtgaaaggaaactgatttaaaaaaataagaatacactcagagagggtagagggcccaaattatacatctgtaatcatatctgtgtacatgtatttaaaagtttttccatccccttagcctccaaggttagtagaggaaaaaatgaagtatacacatagtcctttaaccttttataccagagtggtcaaagaagagcaaaaaacaaaaaaacaaaaaaaaaaaaaaaaagaaaagaaatcatcatcagtatcctcaccaccacagatatttgtgggaacttatgtgctaacactttatataattaattccatctcctaatcatattaacataagtatttatcatcttcatgtacaaatgaaggtagaaacatcaacatgcccaaggtaacataactaggaagtaacaaacttgctgccctctaacaattatactgcctctttaattatgattttaaaataaaagtatcctccaaatggacatttgtgagaaaaaaagaaatttaatcttattcgtatgttgatagcatttagtcaatttaattcaacaaatcgttcagcttctactactcaattccacacagtgagaacaaaattgttgcccctatacttacagaagccttattttaagaggcagactgtagatatataagtaaattacaaagcagaaatatatgcaatgtaatagaaaaactaacatcacacaccagggcctgtcgtggggtggggggaggggggagggatagcattaggagatatacctaatgtaactgacaagttaatgggtgcagcacaccaacatgtcacatggatacatacgtaacaaacctgcatgttgtgcacacgtaccctagaacttaaagtataatttaaaaaaattttaaaaacagaaaaacccatgctctgtgatcagaaagataaatattaatatctgctgtataatctggtgatttttaggaaatttacatgatttaactagcatatggctgagaaagggttttggagggtcagagaataagaatataggatcttattttaggctgtaggaaacaagctagcaaagattaggcttggggcatgcagagtgtgtgtgcttaatttaatgggaggaaagactgaatgtgagttagtaagaattactatctagatgaggaattagtatgaagctacagaaccttaagtttcagtgcctctcacttgcaagagacccttctataaaccagcatttaattttctatttataattttttttttcaaagactgcccctggaaattctagaagctcagcattacaaagcaaagcaaagatagcgtaagtgatcactgcaacacaggccttcctgataagttccacattttcccaaatgagtcatattgttgtcataagtcataaataataggaacaacaacagcttacatataaccaaacactcgacttttatctgttggcaggggacatgaaggaccaagtaacctgtgagaggaatgttgggcaatttggagctcaaggcaaagcattccatggaatttgaaatatacatatttccattaaatagttagaaaaactgttgaggatgagcttctgtgtttttagaaaggtcgccaccactaaaattattaacattgaaaaaaatcatcattgaacatcatataaaagtgagacttttatcataatgtataggcatttctagtgaaattcgcatatttgtagtactgttccaatatgattagagataaaattttctttatgcattgagtagattatgcattaaaaagaactcagtggttaaacatattttggaaattgaagatgaacatgtgtctataccacagaacttctcagaatatttattaatatatattgtgtatatccaagaatcatacaacactttgtagatgttatccttttgcttttttttgccagagtgcatcatacaagtagatttggaaaaaggctatcaaatatacttaacatattcattaataataattcaattcattactaaaattataaaataaaatgtctttatatttccaattgattctactatgggtaagctgtaaaacatgcatgacacatatttgccagcatctttacacattaattccacaaaatttacatttaaattgtaattaacttttagcttgtacttaggatatcttttaccagctactttacctaacctcgtcagaactgtattctggaaccacataagtaaaaaatgcttagcactttagcgcaggcttattgtgaaatagaaaagtaacttgtacaaataacagaatattattgaaacttctgggaagaacaatctcctatgtaaaaatcactcataaaaaaagacaatgtaatcattttcttttttgacattatgagaatatgatgaaagaaaataaaattgtggaagaaaacattggggatagaagattcaatctgaaggaaaatgatctctctacttgtctactagatttctaagttgtcctaaagatgtgagggatgtataatttgagttatattttcacctaatatatacatctagggggatatggatagtaagcatttgaagaaaacaaataagccaaccacatacaactattcttgtgaaattatcagcctggcttcgtataaaatcagtaaactctaatggaaacaaagtgagaggacatagcaaatcacggatactgatgtgaacactcacatatgctctatgaggtgttctcaatccagtacctttcagaatcactagattttcttcatcaaagtcaagtaatataaagcaaattatatcatctttccattatattaaaaaagacatttgagcttatctcaacattccattataaaaaaggcatttgagcatgcagtaactatgttcacagcactatatattcaaagtaggaaaataaaacaagtgaaatcgaattaaccatttttccattgaatatggtaaagggcaaaattatagaaccaaaaaatcattcaaacattaatcacattttaaatataggactttacagttaactgagcagagagcagggctgtttttaaaatcttgctttacctcatcaaaccattctcatatatatagtaacagaaaatggccagcaaaattatactgcagcaggctaaagtacttaacagaatgaagaaaatgatatcaaataattattggagtttctgtggtgtcaaagaaaggaaaaatttagagaaaataagaaaatattttagtaaaagatattaaaatacttcatgttgagactactgattgatggaggaacgtaccactgttagattagtaattttgaaagagccagtaattttgaaattgctattttcaagaaagggaaatggccacatatcacacgtacttagaaaacgaaagaaacaaaatatatcaaaagatttgggatgatatgtactttccaaagataggaaaatgcaagaaatataattattttcatagaaaaaaaatgttgaaaagtttcaggttatactttataataattcaacaagtaaaaaaagaagaaattcacacagctttgtactactctttttttaaacccccccccccaagtagagttacttagaaaaatattacctttaaattaaattttgtcagctaaagaagttttgacttttatcagaaatatgcaataggccaaaggaaacagtctatttcagtgtctcccctacattgttccttgacatatgagttttgtggtatatcaacatatttctggaggaaaaagtgtctgtggcttcttatcaaatttaggttaaacttttatttttgaaaatacaaaaaagtgggtcaaaaatctccagcagagaagtaaagcatataaatttttctgcgtaatcttgaccacagaaccgtttaaaaataaaaaattggacattgtgtataattattacttgtaatatacctgagaaacgatgttacgcttagtcataataacgacaacgataatagaagagttcattataataatgtattttctaacaaagacattcttcacagaaatagaaaaaacaatcttaaaatttatatggaactgcagcagacccagaatagccaaatatatcctaagcaaaaaagaatgaaactggaggaatcactttacctaactttaaattatactacacagctatagtaaccgaaacagcatggtactggcttaagcgcaaacacacagcccaatagaacagaatagagaacacagagataaatccatacatctacagggacctaatttttgacaaagtgccaagaacacactttggggaaaggagtccttcaataaatggtgctgggaaaattggatatccaaatgcagaataaaaccagacctctatcttgaaccgtatacagaaatcaaatcaaaatggattaaatacttaaatctaagacctcaaattatgaaactaccacaagaaaactttgggagaaacctccagaacattggtctaggcaagaaattcttgaaccataccacacaagcacaggcaaccaaagcaaaaatggacaaatggtaacacaccaagttaaaaatcttcttcacaacaaagcatacaacccacaaagtgaagagacaacccatggaatgggagaaaatatttccaaactacccatctgacaagggatcaataactagaatatataaagagctcaaacaactctataggaaaaaactaataatctgattaaaaatgggcaaaatatctgaatagacttttttttgaaagaagataaatgacaaacgggtatatgaaaagggtctcaatatcactgatcataacagaatagtaaatcaaaaccacagtgagatataatctcacttcaactcaaatggttttatttataaaacaagcaataacaaatgttggcgaggatatggagaaaagggaaccctcatacactgctggtaggaatgtaaactagtacaaccactatggaaaacaagttttgagattcctcaaaaaactgtaaacagagctaccatacaatccagcaatcccactgctgtgtatatacccaaaagaaagaaaatcagtacactgaagaaatatctgtactcccgtgttttattgcggcactgttcacaaaagtcaagatttggaagcaacctaaatgtccattaaaaaacgaatggataaagaaaatatggttttctagatatacaatcatgtcatctgcaaacagggacaatttgacttcctcttttcctgattgaacaccctttatttccttctcctgcctaattgccctggccagaacttccaacactatgttgaataggagtggtgagagagggcatccctgtcttgtgccagttttcaaagggaatgcttccggtttttgcccattcagtatgatattggctgtgggtttgtcatagatagctcttattattttgaaatacgtcccatcaatacctaatttattgagaatttttagcatgaagcgttgttgaattttgtcaaaggctttttctgcatctattgagataatcatgtggtttttgtctttggctctgtttagatgctggattacatttattgatttgcatatattgaaccagccttgcatcccaaggatgaagcccacttgatcatggtggataagctttttgatgtgctgctggattcgttttgcaagtattttattgaggattttttcatcaatgttcatcaaggataatggtctaaaattctcttttttggttgtgtctctgcccggctttggtatcagaatgatgctggcctcataaaatgagttagggaggattccctctttttctatggattggaatagtttcagaaggaatggtatcagttcctccttgtacctctgcagccaaaaaacacatgaaaaaatgctcatcatcactggccatcagagaaatgcaaatcaaaaccacaatgagataccatctcacaccagttagaatggcaatcattcaaaagtcaggaaacaacaggtgctggagaggatgtggagaaataggaacacttttacactgttggtgggactgtaaactggttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtctcacaatgatacaatggatttagaaaatgtggcacatatacaccttggaatactatgcagccataaaaaaggatgagttcatgtcctttgtagggacatggatgaagctggaaaccaccattctcagcaaactatctcaaggacaaaaaaccaaacactgcatgttctcactcataggtgggaattgaacaatgagagcacatggacacaggaaggggaacatcacacaccggggactgttgtggggtggggggaggggggagggatagcattgggagatatacctaatgctagatgacgagttagtgggtgcagcgcaccagcatggcacatgtatacatatgtgactaacctgcacaatgtgcacatgtaccctaaaacttaaagtataataataaaaaaaagaaaatatggtacctatacacaatacagtactattcagccataaaaagaatgacgtcctgtcatttgcaataacatggatggaattgtacgttattacgttaagtgaaataagccagtcacagaaagacaaacatcccatgttctcagttatttgtgggagctaaaaattaagataattgaactatggagatagagagtagaaggatccttactagaggctgggaagggtagtcaggggttggggaggaagtggggatggttaatgggtacaaaaattagaaataatgagcaagacctagtatttgctagaacaggatgaccataataaaaaagtaatttgagtctacattttaaaataaactaaaagagtacaactgaattttttatatcacaaaggatagatgcttaaggtgatagacaccccatttaccctgatttgattgctacgcattgcatgcctgtatcaaaatatctcatgtaacgtttatacatctactacgtgcctacaaacattgaaaatagaaataacgtattttcaagtaattatggttacttttcaaaatagataaatgagtaaatcaaactctagggaacattttggaatgctgcctagaaataattgggagattgtacttctaggttaattttcacttaataaagggctaattattaaagtggagaaagcagatctgagttaaaatatcagcttcagtaaaaatgctttagcattaaaattcattaaatggaatagaatgtaaacaatgggaacattatgatattactatgtaagatcttgcggacatcagtaggccatcaataaatatctaccatttaagttaattccaggttatttaacaacattcatcacatttcaccctttgctatgcatcaaaataatggagtgaaaaagttgatggtaaccttaaattatctttttaaatatataatagtaattgatatattctctattcaatagggttttaaaaacaactttgaggtacaatttacataccataaaattttcattttaaacatatagtcaatgaacaataggaaatttatagagtcatgtatatatcaccacaatccaactttaggacattttttattaacccctaaacctgtgtgtccattttcattcacatcctgttctcaacccatgcctcaaccattcatctagtgttttcaaatattcccttttaaacacaacttttatacttcattaggctgctgtaattaccaaataacgtgaatgctttcaaaatattagatattcacatggtataatccttaaaaactaggtaatacataaagaggctaaaatatatattttccatcagtctttccttttcatgtgaagagttccattttatactattcaaagtattttggaaaggttttcagagcttcaaagttgggcaatcataaggcattatgacaagaagtctttatgatactattaagttccattggaaaaatggttcttcactattatggtaaacgtaagtggccagcaatttctaaattttatctttctttggtgctatctaatgagtggcaagatggcaaggaccacgttaggcttattcacattttaaattttacactgcctatcacatttgtctgacacatacttagtgactaaacctcagtggaattcaataaatttgccagctatttgttagaaatctgctgggtggcccacggtcttacagctgaactttagtggttagagaatgggaatagacggggaaaatttttaaaaagcaaataaaagatttaacaatcacgataaacgctgaaagaaaaataaaacatagtatgttatgctaagtgttatctggctgtgcattttagatcgataaattttctgtgtgctatctttgaagtaaatattcatttgcataagacaaaattgggaaataataggataaatttggatcacttcaaaatattcagagtgttgcaatagtgttcactgtggctgtagcgtgaagttattagactggtgcaaaagtaattgcagtttttgccattaattttaataatttcatccttatatgtagaatttgtagatagatttttacaaaagcatactatagtttaattgcagtcttaaaatgtacacatcaaaataatatgaaagaaatctatatctttatcatatagccagtgaggacataataatgtacaggttgtccaagtacagtcagtgacgtgtggcaagtttctagtattttacatttcctacaacttgtgtttatgactgtttcccacactattaaacatatgaaactaacaagttattcttaaatggagagtaataagttctgtatagcaacacataggggtggcctttcaatgttagaacagattcaaaattaaatgcactaggtttaccatctactgggctgtgtaaaaagaaaataaaaagtctacatctatggctagataggttttaatatttgaacccaaatctctgggttagttctccatttttttcttctttgactaaattatccaattaccacataaattcccctttgcaggtttctgctgtctaactcataaatcaataaagcagactgtaaagttacactgttccaagtcgtttggcaatcaaatatgcctatttacactataagagtctgttttattccttaatgaaatcaaaagctcaatctgatagaccaaaatctgcagttatatctttatttttaagccattgattttgatagcttggaatgttaacatttaaagatgaccgattatatttaatgtgagttataagatttagcttctttgataaacacgggaagattgcaattacgaattcttcttaaagtgcatttaacgtaattagtttaaattaatagctttctttgctttaaaaatcccctcttttctaaattgtactcacattgttaatgggagggaaaaagagaaggaggaagtctggtctgtagtggactctggaacacctgacgtcctagcttggtgagcaaaccacggcagtatttttcaatatttaattatgaggcactcttctttgaaggtaatttgtttccttcctctattcctgctcataaatctactatgtgggacacgaggttacaaaaaaatgagatcagaattctttgggaaaaaacaaatagaacagtaaagctactggagccactgctaagcaactccgctcttgcttgcagtaatttaagcaacagggccatgttttcccctacaaaatgtgcatcaacacataaggacatggtgactttcaacaggtgcccatgttgggttgttcttacatatcaaagattcaaaactaaaattagtagaaaaggaaaaaaatcatgtatgtgaaagtatctttgtaattttaaaaattgcaagacatttaagtagctatttaaacatagttgtcactgtcccctaaaatgattaagagccatatgcaagttaattgacatgttaacaaatggggttagaaaaaaatgaattgaagaaagccaagcagagttcagcctcaaacatctatattgaacattctttttgtctaaattaaaatttgtgcgatagctctcagctatattttcttccatcacccattttccattagaggaaaaaatcaaaataggagagaatctcaccagtagtttgattgccactctgactccctcccattgaaacgttgacacagtcatagaagagaatctttatagaagagtgatagaaaatgtcgtatgaaaaatactctggaacaatttagtcattactagtagggaaccatccaaagccattctccaattagctacacattagaatgaataaaaaagtttccaaaaattctgaagaccaaatccacctaaagatttgatttgattgctccggggctcagcatggttacttagactgttgctataggattttaggtgccaaaactaaactctgtgcttcaatatatagttctgaaaaattgaacagtaaatgactaaatttgttccatgtgtttctttgcagtcacacaatttcgtgatttaattttttatttatttccaaggaacacgcataggttgttacatttttaatcatagtactttggaaataatcctagtttctgttttctaagatatatttccatatctagaagagttttccccatttgctttattctgtttcaataaatcttttcttaattttgtactttaataaaatctctcattaaatgagctgacactgggtagattgatgctgtggccatataatttaatttaagactgtggtaccagtaccatgctgttttggttactgtagccttgtagtatactttgaagtcaggtagcatgatgactccagctttattcttttggcttaggattgacttggcgatgcaggctcctttatggttccatatgaactttaaagtagttttttccaattctctgaagaaaggcattggtagcttgatggggatggcattgaatctataaattaccttgggcagtatggccattttcacgatattgacacttcctacccatgagcatggaatgttcttccatttgtttgtatcctcttttatttcattgagcagtggtttgtagttctccttgaagaggtccttcacatcccttgtaagttggattcctaggtattttattctctttgaagcaattgcgaatgggagttcactcatgatttggctctctgtttgtctgttattggtgtataagaatgcttgtgatttttgcacattgattttgcatgctgagactttgctgaagttgcttatcagcttaaggagattttgggctgagacaatggggttttctagatatacaatcatgtcatctgcaaacaggaacaatttgacttcctcttttcctgattgaataccctttatttccttctcctgcctaattgccctggccagaacttccaacagtatgttgaataggagcagtgagagagggcacccctgtcttgtgccagttttcaaagggaatgcttccagtttttgcccattcagtatgatattggctgtgggttcatcatagatagctcttattattttgagatttgtcccatcaatacctaatttattgagaatttttagcatgaggggtagttgaatattgtcaaaggccttttctggatctattgagataatcatgtggtatttgtgattggttctgtttatatgctggattacgtttattgatttgcatatattgaaccagccttgcatcccagggatgaagcccacttggtcatggtgcataagctttttgatgtgctgctggattcggtttgccagtattttattgaggatttttgcatcgatgttcatcagggatattggtctaaaattctctttttctgtatattacaaggctacagtaaccaaaacagcatggtactggtaccaaaacagagatatagatcaatggaacagaacaaagccctcataaataatgccacatatctacaactatctgatctttgacaaacctcacaaaaacaagaaatggggaaacgattccctatttaataaatggtgctgggaaaactggctagccatatgtagaaagctgaaactggatcccttccttacaccttatacaaaaattaactcaagatggattaaagacttacatgttagacttaaaaccataaaaaccctagaagaaaacctaggcattaccattcaggacataggcacgggcaaggacttcatgacgaaaacaacaaaagcaatggcaacaaaagccaaaattgacaaatgggatctaattaaactaaagagcttctgcacagcaaaagaaactaccatcagagtgaacaggcaacctacagaatgggagaagattttcgcaacctactcctctgacaaagggctaatatccagaatctacaatgaactcaaacaaatgtacaagaaaaaagcaaacaaccccatcaacaagtgggtgaaggatatgaacagacacttctcaaaagaagacatttatgcagccaaaagacacataaaaaaatgctcatcatcactggccatcagagaaatgcaaatcaaaacaacgagataccatctcacaccagttagaatggcgatcattaaaaagtcaggaaacaacaggtgctggagaggatgtggagaaataggaacacttttacactgttggtgggactgtaaactagttcaaccattgtggaagtcactgtggcgattcctcagggatctagaactagaaataccatttgacccagccatcccgttactgggtatatacccaaaggattataaatcatgctgctataaagacacatgcacacgtatgtttattgcggcactattctcaatagcaaagacttggaaccaacccaaatgtctcacaatgatacaatggatttagaaaatgtggcacatatacaccttggaatactatgcagccataaaaaaggatgagttcatgtcctttgtagggacatggatgaagctggaaaccatcattctcagcaaactatcgcaaggacaaaaaaccaaacaccgcatgttctcactcataggtgggaattgaacaatgagaacacatggacacaggaaggggaacatcacacaccagggaatgttgtggggtggggggaggggggagggatagcattaggagatatacctaatgttaaatgacgagttaatgggtgtagcacaccaacatggcacatgtatacatatgcaactaacctgcacgttgtgcacatgtaccctaaaacttaaagtattaaaaaaaaagactgtgaattggctaagtgttatcttttgaaataaaatactcctaggtcaacacatgctgttacatcctggcagcatgcagctttattttctaaaagtgtaagctttgcttctgtaggtaagctcatgtcactaaaataagtaacataattttaaatccaattcagaatctgagggcccagagaaataactgatcaattaacacactaaggaagtgagcagctcttttctttcctatagtaataaatgccaatgtgaatgtaaagaagcatcctgatctacatctacttttatatataacaagagtatggttgtcagaaagttgtacatacagtatgcatttccttagtgccatagcttttatatctgaggatctcaaacgatcttaaaatgcagaaaaaataatgctctaaaagattcaaattaactagcaaaactctcagtgcaccacacggtggagtcagacacccacaaatctgcgtgaccagtatatgacagaaaatctgagcaggtatttcaaagaggacttaatatggtaacttcatacattttttcctgcttctccgtgatgaattaagctaaatataccatttatgagaaaagaaattatagtgcactaatattttaattagcaataacctttttatctttaagtgcaaatttatagaaacacatttttgttaatacaatgcattgaagttagtccctattctattcctttcttttctttctttcatctatctatctatctatctatctatctatctatctatctatctatccatccatcaatccatacatccatccatctatccaccccatctctatatttaaaatgtcattttggtggcattcttagtggatccttcatcttacacactgtgcttatgttatttcactatctaacttttgactctctattttatttcatgggaatttcgagctgcttttcaggaaatataatccttgaagcaaatctgagtacctgagaactctgttctagaaaacaattcacttactgccatattaaaataaaaccctggagcagaagaatgttttaagagctttcagatggcttgtattctccaatattatgtattaccattggggagactcaatgtcaagaactatgttgataatgcaggtgtgacctgaaatgcatggaaaatagatttgatctgaatgcccaaaatctctttcttgaagtagatctgaaatttcataatttatctgtgttctgctgtttactagtacttttctactgatgtagttaataacatttttattgtagtatttttttagaaaaaccaagcaaaatattttgctattaaaaacaagtaatgtttataaaatcctgaatccatttctaaataagaaaaaacacacagtgccccttatcacaacctgttcaactaaagatgcttcgccctaaaagctccaattttccttgaaagacaatagtataatagctttgcctatcaaatttgctactcataatttcattccgcaagtctgtcacaaagtaattctttatgcattttgaagtacaaacttgcaatattaatgtctagtattcatactgctcaaatttttccttaattccattcagaacgtcacaagcatttttaatcaaacattccttcaaaactcatgtcattagtttaaatgaaagcagttctactctgtatttcatttatagtcatgtagttcttctcaattcagaaacaattactcattcctatcatgcattttactaaaccctgccgtggtagacacactaaataccctgacttgatcattacactttctatacatgtaagaaaatattacataaatgttgtatccataaatatgtataaatattttatatcaaaaaacctttttcattatgactcaaactgggacggacttaggaatagttaattctagagaacctggcttgtgtaagtttgaaaaatatatatactggagtaggtttgtataaacctatcacacttaccctctaaaatatgtacaatcattatatatcaagacaaattaaaaattgaatcctcaagtatgtttactattatccctcacttctactacaatatttactcttgttgcccagtggaaaactatgatgaggattttatcatcaggattctccccaaaattctctttcttcatccactattgcaattgtatgcactccataaggaaataatattccctggactttttaagcctatcaaaactacctatactctgccacatattatcagggacattcttggtcaaagttagacaatatggtaaattaactcatgctattgtgtatactgttgcccagaacacctattaacggtgattcattaactgtaattgcattgtaaccatgatctacaaatctaatatatcacccccaaattcattttaaagtgaaaaacttcagacatcttcaccaactggcagggagaaggctttgagatttgcagctaaccttctagtgctcctctcatcatagcatggacttggtgattgggttcacaacatgtatataagatttgaaaagcagatctagtaattgcgatcacacaaccctaaagacttttgaataaataatacctatgataacttcacatatgtttaaatgttaattaaaaaatgagaacagcattttaaaaatacttcttacagtgaatgtaaatttagttatggcctaaaatttactcatttaaaagtcaactcagatttattttcaacactattttaattctcattctagaaaaacaggtaaacacgttttatattttcgtttgaatgaagcatgggagtgagtgcatgtagctatattgagcatgatcattaataattgaggtgtaaatttatatcgataattttgtgttactcactgcttgtaactaacacatttttataaaacaatatagaccatgtgactaaacgaggagtttataataaaatgtttgagactgctttccaacaatgccatagaaaatattttctttttttctttttataagatagagtctcgctctgttccaggctggagtacagtggtgcaatctcggctcactgcaacctccgcctcccgtgttcaagtgattctcctgcctcagcctcccgagtagctgggattacaggcgcgtgccaacaaacctggctaatttttgtatttttagtagagacagggtttcaccatgttggccaggctggtcttgaactcctgacattgtgattcgtgggcctcagcatcccaaagggctgggattacaggtgtgagccaccacacccggccaaaaaacattttctttaccatttactatcctatggttttactctagcttttagtatagtttgaagtcagaaacaccagaacgtattgctcctgtctttgaaatgtctttatttcaaattcctccattacatccttaaaaaaataaatcttagactaatgatctagacccccttttcttcctacctacctccaaatagtcaaatcagtgaatcaaaacaaccccatggaaaactagttgaataaatttaaagttagaaacactgcaacattttgttgaagtaataaaaacaaaagaatggaagctgattcccagatgtacttgcctgggcttcctgaggcatttgagctgcgtccaccttgtctgcaatataagctgccaactgcttgtcaatgaatgtgagggactcctggattaagtgtaaggatttttcagtctcctgggcagactggatgctctgttcaagcaacttttgcctccttacagcctaaaaagaaggaataagagtgtatcagttaaatgtttactcttgatagcttttctgtaatcctgctgaacaataaatgaagattctagactcttccacaatcacctttttgtaagacagatttcgcagcttcctggcactcattcagctctgttgatagaaaaaaaatgtgaaggagaaaaataaatagcaaacaaaactataggatcagggatctctgcatgaaaatcaatcacaatatcacgtacattaaggaaataggctggaaaaaaaattagcaaaatcatctcagtcattgcaatctgtctttctcaggtcgaatgttcctcctgatctcattatatagttcaagagatttggtttgcttagaatagggtcatcgtcatcacaatccaattcaagacagataatctgcttccaccagtgagatacatgtacaatctgttcagaatcagctccttgtcaaaaacagaattttagataacagtctggttaaagatttattttgaatactatttcaaccagctttgcatgatcttttttctccctactttctttcacaatttggattacagaaattgtttgtacaattgggtttatgttactgctgaagtagaaaaaataataagtaatcctaatatagctgcaattaatcttgattgtaactataagtatgattaggataattcaataatgttcaagtataaataccatgctgcacagattggaaagtctcccttcaaggatctgttcacttttaacagagtagttgtaaaagtaagaaatagggcaggcaacttattgggaattcattatgtgtcatttaaaatacatttccttaatatacaatgtaaaggcatgattatcaggtacaatataactttctttcccacagagcatgactgaggttttaagatgatcttggtttttatattatatatagaatattagatattacataaatactatactttttaagctttaaaaatattagtgatgtcattattcttcagtgaagccagcctataacacagctttgcccaagtaaaactacagttaaaggcatctagactaaggcaaaagaacaggaagtttagtgatgctgcaggaagagggaaggctttcccagtacttctccctgtaccataaattttgactccattaagattttatcctgggctttcctttcttctcattctacccataccttaacttcaattcctcctcacattctgacaactctcaactctacatctctcaagtccagatctccccttgatctccatacttgcatgttatctcaccctattggacatctcctcatgaatattctgcaaccaccaaaagctaacactcccacacatgaactccttgcatatactcttctcacctacttctcaactccccaacttgcttttcctccttctctgtattttttccggtttcagcgaaaaacaaataatgattccctttattagatgtaattctagatatttctacttcctctatcatgtccttcatcatgttgcatctaatcagtcaatcactaattatttattataccttctaaatagttcttgattccaatcttttctctctctctccattgtctttactctagttaaaatcattactatatcttacctcaaatatgctatcagtttcttcactggcattttactctgccacatcccacctgtaaagcagctgcaatgtgttctctcaataacgaattggggcttcctgtctaaaattctctagtgattctttactgtccttcaaataaaagctctattcttttttttttttttttttttttgagatggaggcggagtctctctctgtcacccagactggagtgcagtggcacaatctctgctcactgcaacctctgcctccctggttcaagtgattctcctgcctcagcctctcaagtagctgggattacaggtacctgccaccatgcctggcgaatttttgtatttttagtagagacagggtttcaccaatttgcccaggctggtctcaaactcctgacctaagatgatccacccacctcggcctccctaagtgctgggattataggcgtgagacattgcgcgcagccaaaagctttatccttaatgtggcttaaaagtcccttcataatataagtcctgctggtgtcttttactccctgctctagctatacagaaattttattttttatttcccaacctacactgtggccctcttgattcttggccttaaacatgttgttcccttttactggcataatctcaattctgacttccttttattggctaatttacatttatcttcttaatgtagtggacatctcttccaagtggctacctctggcaccttctaagttcagggaggtaattcttgcatgttctttgaattttgtatttttttgatttgacaagtaaaaattctatcaagttagagcacgtaacatgatgttttaatatatgaatatgttacgggatggctaaattaagctatttatgcattccctcacatgacattatgttctttcttgcactttgtatgtgccataacatatttaatctcccattaatggtctgcatttactttagactatcaactctaatgagttcaaggattacggctgtcctgttcattgctcaataccagttcctagaatgaagcccaatagctttatttatgactgggtgaaaagtataaggagaaattttaatgagaaaaacagaaaactttaaatagtcaaagacgaaaatggatttacagaagaaattgtaaacaaaggtcaccactgctcagagatgtatcttttggacaataaatctatctgtttttgtattaaaagtgtcagaatgggggtgggacattatttggagaaaattttaatctctttctattaaaattctgtatccaagattggtgaccgaggctttgccctatattccaattcaaacatagcttccttttgttctcagtcaaaatttcaactaaaatttacatcaggtaatttactatttcagataacagtgttcagggctataatcagagcctctattgcagaggagactggctgcagcctacccacagctcttccaaagaaatggatctctagtgataaaatttcagcattgtgacaggtggttggagaaaacttccaatcacagcgtgtaataattgcctagccaggtattaaatttggtccttcctctggctaaaggcaaaaacagtgtactctacaaggcacatctgtagattttaattgtataggatgtaatatagaataacattaaaccacatatctagcctcaaaattctttttagaaacctaactttttctattcatgagattctatgagctgaaaggaacagtgtggcttaagaaatgatggcagagttgacttcgggtgggttggctcttttcctggcctgacagtcaataagagaggctgatttacacagattccttgattatctcagtcattgaaaagacctcatgtcaatgcaagcttgcagaattctttcaactagtcatggcataagctgccttctatttctaaacatctgattaggcgcaccctgatggaatgtcaggcttatgaattttctgactttctgcccgcttgacctgtgctgtctcattgaatgaagtttgtagaaagtcttcaaccataatctgattttttgttgttgttccagaatactgttccgctgttgttttaaaatgttatttcatgtctttagctaatccacttagcagtaagaggaattatatagctagacagaaacagcaaatataaggaaagttagaaagacatcttttaataactggcgatcaatgacaaaaatataaaaatagaaaacaatcctagtaatggttaccaagaaaaacacataatatattttaacccagttttcaatgaaaattaaaactaagtaaaagttaacacaaattaattattttatatctttaaagtactatggaaatataaaataagtttaagaaaaagttttaagagtttaatgagttttgctggcaatgtaaagtcatctctacaatgaattgacagtttctcacatttccattttaaaaataatgtactaacctttgtaccacaatattacaaacacataaatcaaagtgtagcatgtctaagaaactctggaagagaaaactctgcatgtgaaataaaaaaccgaatattgaaaccaaaaaatgtatttaacatatgaatgcatgctttaaaaagccaaattagaaaaaaaatcatttaataatattttacaaaaaacacattcattaaaggagctaggtatcctatactatacttattaaactcaatacaaaaagcaattttactgcatttatgaggtgatgggtaagcttatgcttgcaaatggattaagaatgtgggtgcactgtttacaatcatctcgtaataagacacttttatttttggtgtttaaatactcatcattgtattcatcattgtgatgtagacatgtaaaacatttcaatttccagcagttttaaatattttcttctgagtaaagaaggatttttgccaatgtcaaaataaagccctcatttttatgagtgattttagtagtaaatgaactaacgaaaactaaatcccaaattccaattcaaataaagcaaagcaacgacaaagtcttgaagtttctgcttagggtagtgcattaattggccccaacctgactgtccgtaccttgcagaaagtagagcaatatggaatatgttttattttatagaaagtgtcttgggataggagtcctgcaagagatgtgctaaaaccaaatcctactcaacctgcccttcagaaactacagtggagacccatgagaggacattaatctccatttgacaaccacgcttcacttcacagagtttaccagtcaagttttctttcccagagtctcaacttcagtggaccaagcaacacttgcttcagtggatcaagcaatagttcagtggtccaactatttccttttagtgtttcttttttacctactaacaggttgcaatttgttcaagtgccaagtactaagaatactggtgggtgtatatcatttttgataaactatttcctcctgacctaactcttctatttaacttaagagcaagtgtgaaactgtcactatggatatgaatgcattgaattctatctgttgtcttagaattttgggtatagtcttaaactgaaaataacaagtaataagtctctctcattctaagagatggaaatagcagggcatagcaaagggcttacaaaagagctgggaaaactggccctgcctttgttgctccaccatacccacttatactaaaactctctgaaggttttagaaagaatcggtcttctgaattcatggcccagagggagagtagggatggctccctctgtttattccgtaagggggaaaagaagatggtacttcaacctttttgtcccatgcaagtaagtggagctccaagaccactgatcacagggtctgggagtccagagtagatagggatgacacctaattaccaactctgcttctgaagatgtctgcttcagaaattatatgcctacttgataggtaaaaaatgaatgagaaatgatacagtgaagaaggggggcagcctgtactccccagtgcttggtgtggcaaacgtttctcaataggtcaagtgaacgtggaagaagacagccatgtttgagctatctaccaggaacactctttatggagcaagagtacctcaggatcaagaggcttgaagatgtttttatagagcatattttccttcttaaagatggggaaaacaaaagagcttctgcaagacttcttaaagatcccatacttgtaccccaaataaacccgaactttgtatctctgttacacacacacacacacacacacaaatcataaactcaaagctacaaatagctagttaacaggagacatttgcctattttccttaactcctacttcccaagacattggagaataatataactgaagtgcagttaaaaaaaaaaaaaagaaaaagaggcagtggaggtgtaagatggaatctaaccacacttgccttccagagaaagtcttttagaccatggcttaagcttgagctggaaacaaggaagcatattaaattaaatatgacattgagattttaagctgaacccaattagatttaagtctttattacctcagaggccagaaagcaaagggatctattcatggcgccatctacctggatgatgtaaaagcatttcatgtttctgatctatctggctgaaactacgcatcaaactactaacacagtccacgaattcagcacttactcaaataaagcaaaggcaaaggagaatgatagacatccagatcatctagaatgtggtccagcagaagacagaaaatggtttacgggaggtctgaagagataaagaacttaagaaatatctgtgaaaaatggagcattatagtagtatcacatgattgaaaagctaagatagatatgttgatgcttttgtctcatgcaactgcaagttgcatgttttatatccgtctaccaacatacatgaatataaataatccacgtgaaaactattgctcctgtcaaatgcaacaacttgcctactgattggtaactttgctgaacaaccaatttaaattcctgaagcataattctaaggtctttaaagaagcatgccataaaagtatcaggaattatttaaggaccactaagaatgttctatttgtctcagaaattggttcttacaatttttagttgtttagaaccggcaagatgacagccttaaagaagttgacacttcaggagatcgaaaccatcctggctgacacggtgaaaccctgtttctactaaaaatacaaaaaattagcctggcatggtggcaggcgcctgtagtcccagctacgcaggaggctgaggcaggagaatggtgtgaacccgggaggtagagctggcagtgagctgagatcgtgccattgcactacagtctgggtgacagagtgagactctgtctcaaaaaaaaaaaaaaaaaaaaaaaaaagaagctgacacttgaagcacacattgtattgtacacttgaaaaatctttgagattgattagataggaacactttattttccataatttcatatggtgttaagtaatagatcctttaaaagttatacaaaaatttccagatgtctagatatgcttataccagcttaatgaaatgttttccaaaaagaatagagttaggattttgaaaagggaattaaatggagattaagagaaaagcagagggagaagaggataatttacaacagaagaaataatttaccaatgctcatagctcatcacaagattcactttgttgctttctttgttttcaaattagttcatcctattttttcctaaagaaaggaggtctcacactgtgttccttggacaagaaagactaagtaaattaaaaccatgttgctttaacccactttaaatataactcttgtgaggggctttggtacagtggtttttcctgtggcatatttgttaatgtatttaatagggatataggcggtaaataattacaaagatgtgtacatgtctgcatatatatcctttaaatataaaataaagaaggttacattattcacgaaaggcttctagatttatgttttgttaatgtcactaggtttgaacacacctgggagaaaactcaaaagccgtgagcatggagctcctataattttctttaccaggaaagaatataaatgtgaaaactcttggtgtcatggttaataggaacttcacctgttttaggttttagcaggttactgaagttcttctgtgacctctgaaggaagcatacttgaaagtaacgtttgggaatcattttatcaatggaacttgacatcagatagccatcactttcaagtaaagcattgagcattgatagaatggtcaatgagctatagagtaatatatctaagacatttctggattcttgctgcatccatttatcctcatgggtagacaagtgaaattggtcttctgccctgacaggagcaaactgatgctttatttaagcttcaaaaagaaagtgaatgaagcattattcagtaaacataaaataagtctacaggattcatcatatccaagctttctcaaggtaccttcaggagccaccctaagtcagtgaaatttttccggcccaatggcgaggtactctttgactgcacatgtgttcatattattaaagtctaaactttaggcagtgaataatttattgatacaggaaataattaaaatatttaagtcgctgtctcctgatatggaatagtgagacagaatcagattctagggatgacttggtcagcattgagaccacatgttcaagcaaaatataaagtttatacatgagacaaaagtccaaatctggggataaaatcaagttggaaaagatgagaagtcaaaattagaaaaaatgtagctggtgcttctaagccaagtggtataggttaattagccaaatacagaagtacccaagtgagagagagcatactgaggccaattacagataggttggtggttgtgagcaaactagtccttacaatgtagatgaactagccagttgatagtcctcttaaataaggtcagtgatatccagtcagtacagtagtgtgacaaagatctcagagtgaaagaactttggaactcgttagtccctctacttaggaattcagactctcaggaaagaaactcaacacagcatctctggctttctggacttaatatgatgtatgggaagcaaattcatcacacttccttttatagaccaggtaaggatggccacacaggttgcctatgaataaaatagtttccaatcttcagtcaagcagtgtgaaatacagccttgataactagaaatggtgcttttctgatgtgcattagagatctctgctggattccttctactgtgatgtaggctcataatactctaaggccagtgttcaggttctcttggactacagtgccatggattttgccggcctctgtggtcaactgtaattcatattggttcgaacttgaaattgtatctgagcaactggaaaaatgctcctctctcctgggatgtctgggacgactggtcctttttcatcctacccaattacatgaagattaacaatatttatttatcacaaatactccagatgattgtcatggctctggagaagttgatgtgcaaggcacagtatgcttatggcttcctgtcatcttacttatccacactacattgaaaaagtcctcaggtctagctcagtcagtatctacattattgtgtcctaaggttattacaaggttttctaatattttgtcctccaagttgttaggatagacaagactgcagttttgtagaaaagaactcctaccaggatctttggctctgatatgattcatttggatgggatgtgcaccttgaacagcaggaacatggtgtatggaacagctgcttttccttctgctttcgaaacattctgtatagtgctttaggagtaggttgggagtgcagaaagatgactcgtgtgtttatatgagcatagggaacagataaacactggcagaatgatgcattacaatcgattccttgttacagactagggtcatctgccacaaaatgttcttacaatacattaagcttgctgaaatagaaataaactggttccaaacttcctctcttctctatgtcctcaccccacaatggcatcttctcatcgtctatagatgaaacccatcgtgctggaattatttggcatgggagaagaataaacaggtttccggtgtgacgctttaacttgtaggattgttaaacttgtcatacctcagatatagctgaagattaagatgtggacaatgcctacagccatgcaggactgcttagcatcttccccacaggaagtatctgttccgtcaacattgtggttcgggtgagggagagaggtaatatataatgaggatcctagtgatgccctttccgtgtcatcaaaaatctgctgcagtttcctagaaagcgttcattctacttcagcagggaactatggctgtgaaggaaaaccactttttcctctgcttggtttagttgttgaggaattggaaaggagcttcatttctggaatacagagatcatctatctgtcatgagcagtggttgggcaagaataaattactggtccacagtgggaatgaacctgacacataatgcaccttagcaaagtgcaccttatacatgtgctgataaaggtctatctagactggggttcacaaacctgaataatcatcagaatgaacttttccaaatacagttctcagcctcaattaaaatctactaaattagaaaatcagagggagtcaaaagtgggtatgtgtacaccaaagtccctatattcttctatctgtgtaattttggtgatgagctgaaattgagaaggtctatgaagaccgaagttagaaagaaaagatgtcttaaataacaacaacgaaaaataacaggtaagaaaatgcaatcagttgggcttacagcaaaaaagagcgaacagtagagtgctatgaaattggtattaatgctggtcagaatatacgaaacatagtgaggtagaaacagtaaggaaattctccaattttctttgatactttcaatgaaaaattactaataaatatatgcattttatgatttaaaagacagcatgatgaacttgaaaaatatttttattcctcattccatctagggacactggaatacactgcaaagaaatgttgtttaacattcccttttccatttatcattttttttaaaaaaataaacattttcagaaatttggcctgaatattaaataacagatttgattattcaatctcaagaatctatgaagtagcttgcaaagaaaacggttttaaaaagttgagagtggtaaaacgtaagatgaaagagagagatgaatatgtaccctcagaacagtattgtgtgttatagaaattaagtattagttgtcaatcatcatagataattaaagttattgacaagtttcattaacataaagatataaactcgaggaatttttctgaaaaggtacattgataaacttaaaagagaaacttcaatccaaaaatttatcactaaaatgctactttatcaatccatactactgatttagcttttacaactgattagtttttcggccttaatggttttcctttatgtattaactccctcttttgttattccaactttattattctttttttttttttttggtaggcccttgtagaaaagctattccaacttcagaagaaataactcaactatcaaattatgagatatttgaagacaagataccattaaatggatatgttaacactcattcacaaagatattaatgccctccaagagcaaacataatttgtctagagtgaatattaaatacttaaatattaatcatatattgaaatgcagtacatgattatatgtatacatatgtgcttatatacatgtatatataaatacatgcaagtatatatatgtgtttgtgtgtccctttgtgtctggaccccaaaaatgctaatattctataataggcatacagacgaacaaaaacatttaactactgttttatataatatttcggaaaagtaaatatgactgtccaaggaaacattattgattgaagtagggtaaattatatctaaaaataatggaattactacttacaaagaaaaaatccatgattcatggtgattaaaataagaattaaacacattcaccacagacccttttgtgaaggctatgtactctttcagttcctgtagctataaaatagagggtaactacatttaaaatacaagatgtattttaaaatattattaaaaacaagaatcaaggtaactcacacaattgatggtaggacaagaaaaatccctttctcaaataacaaaagaagatacatgaaatagagaaggaaaaatttctaatttacaaagaaaatagcatacacattcatgtctatttttcttacattaaagaggtctgggctattgagtttattatctatgtgtaaatattacacaagtgggtttcttcccctcaaaatgtaatcactcttgaccatttattcaattaatattattatgagaacaagttgcatagtccaccactcagctgaaaattgcagtcaccttgaacacagaggtctgccataatagtctgcttgcagtgcaatttttatataaagacaaaggttttttgcagagcattcaacctaggagaagtcaagattcaagatatccaatatcctttttactacttaaggaaagaaagccctgaattcaaagtatggaaagatgtaaacctagaagctatatccattattaacacactaagaataagattaaatttcacctttctaaatattaaagcatttattgttaattaattatcctcaatgaaatattttcaagtaatgataatctataaaagtgagcctaaattgttaactcccaaaccttatcaaaagcatttcaggtgtacaaataaccaaatgtataagatgacacccgaaattggcttcaaagccatgcaacctgtgcagttatgcagtaactcatgcttaggagagcccatgcttggtttaatgctctgctgttgccatcttacaatgcttaatttttgagtatgggacccagtattttctttcttccctgagtcccccaaattatggagccgatcctgacattttgggaaaaacagccaacagctaaaagactgacataaaaatctgaattaaattggttaagttagagagattgtaaaaaaaaaaaaaaaaatacatgaaattcacatttgacatactggcggtaaccagatgaatgacttgcaaatatgaatatagttggaagaagatacttcagactagaatcctagttgtttcagaatataatcaaatacaacctggagatgctaatcaaagataacgcaaagaaaaatcccttcgcttttgattttctatgcggctgtatgtgtgtggttctaaataaaattattttgcagaaaattacgggagaaagtcagataactgattatttccattgcgaataacttcattggctactactgagtccacgatattattctctaacacttctcctgattttaaacgaatctttaaaacaaaagagctcctattccaaatacttttcactctcatttcctcaatgacaccagttctcctttctcccaaccccctttaccgtgcagagtcctaaacaacctgaaaacagagttacctacttctcagggataaatttatccttggtggataaactttctcaaacttactactctccacctcagaacctccttgtattatctcaattttctctttcccacttccaaagtcaatccttccattttttttgctcgtgtatcctatcttgtaagactttgctcttatatattatgtctttctattggatcttcccttatactacaaacatgcttaaatttttattatcctgaaaatcaacaacacatcttttctgccctattactattcaatttcagttactggcctttctttctcattttttcatcatcacagatttattgtctctatttgccctgctcattttctcttttaccaaatcttaatctcacagttgttcctcctcactttggaacacagagactatatttaatgagagaaggagcaaagaaatacagctagtggaggcatcatgttagctgacttcaaactatactacagtgctacagtaaccaaaacaacacagtactggtacaaaaacagtcacatagaccaatgaaacagaatggaaagcccagaaataatgccacacacctatacccttctgatcttcgacaaagccgacaaaagcaagcaatgaggaaaggactccctattccataaatggtgctgggataactggctaaccgtatacagaagaataaaaccttacaccatatacaaaaatcaactcaagatgaatgaaagacttaaaatgtcaaagcaaaactttaaaaaccctggaggataacctaggcaataccatcctggacataggaatgggaaaagatgtaatgatgatgtcaaaagcaattgcaacaaaagcaaacactgacaaatgagacctaattaaattacacaacttcctcacagagttcctctgttgaactctgtcaacagagtaaacagacaaactacagaacgggagaaatattttgcaaactgtgaatctgataaaggtttaacatccagaatctctaagtaacttaaacaaatttattttaaaaactctactccattaaaaatgggcaaaggacatgaacacacatttttcacaagacgacacacatgtggccaacaatatgaaaaaaaatgctcaatatcaccaaccattagagaagtgcacattaaaaccacgataagatgccatctcgcaccagtcaaaatggctattattaaaatgtcaaaaaataacagatgctgttgggatggcagagaaaacagaacatttatacactgctggtgggggtgtaaattagttgagcccttgtggaaagcagtttggcagagctaaaaacagaacacagcaaccccattaccgggtgtatagccaaaggaatacaaattgttctaccacaaagacacatgcacacatatgttcattgcaacactattcacaatagcaaagatacagaatcaacctaaatgccctccatggtagactagataaagaaaatgtggtgcatatacaccatggaacactacgcagccacaaaaagaaggagttcgtgtcctttgcaggaacatggagggagctggagaccattctacttagcaaactaatgcaggaacagacaactaaatatcacatgttctcacttataagtgggagctaaataatgagaatacatggacacaatgagggaacagacactgggtcctacttgaggatagagaatgggaggaaggggaggatcagaaaaaatacctatcaggtagtatgcttattacctgggtgatgaaataatctgtacaccaaccccccatgacacactgtttacctgtataacaaacctgcatatatacccagaacataaaagtaaaacaacagctagatctgttgagaccatctttcagatctgctaagagaaaggctggtaaagaaagacaagaatcaaagttcattttaaaagttttggtatgagaaatttcaggaatgagatggcattaacagaggtggagaaaacggtgttgggtagctttgataggagctgtcatctgagtatgttaagtttgagtagcctatgagatatccaaagagaaaaatacacaatagaaggctggatatatggtctgaagttaagggcaaaagtctgtgccagagataatattttgggaataattagcatgtaaattttatttaaagccatgacactgcataaagtattataaagagtgaatatagaaaggaaagggagaacattaagcttaaacactgtttcatacacacttggatccagttggccaataatttgtttcagaacttttccttattaatttatgactgaaattggcatggggttttccttcctgtttcatttttgtctgattttggtaaaaaaaaaaaaaaattttctaaccttatattttccagacatgtatattgccttgtatgttctactgagtttgttgatgactggaattatctattcctagaaagtgtgttcaaatttgaatgtaaaataatttcagtctaatatagtctttgtaggaagacttttaatttgtgattaaatttctgtctcctcaggctttctatatccccttccatcatttttgtagcaatattctcctagaaattcatccatttcatgtaagtttctaaacttatttgcatagcttttagtattttctgtattttaaaaatatattataactgtagttataacattttcatccttaagattttatatttgtttttacttccctctcagttgatttgtctaattaaaacatgaatatgggcatttaaattttattgattccatgttgtttttatttatttctgctcttgaattcttctctttccatttactttctctgcatttattatacttttccctattttcttgagatgggcagttagctcactagttttcagcccttccgtctcttctacaaaaattaacaggaaccaattagttttaatttttatttttattatcactcggttctatgaattttaaccatccattttgaattcatctttgatccacaaattatttactttagtcaagtttttactattgattctagcttgttacaaatttaagagtatttccctaataataccaaatatgtgaaatgtattgacatttccatgtacttcagatgaaatttacactctgatttggggttctctatacagtctttatatccaccttatcaactgttaatcatcactatcttcactaacttttgtctggtgtcttgaaagaaagaggcattatgaaatctcccaccatgctgatatagttgtgtatttcttcttgttattctgtggatttttgctttacgtgttttaaaggtattttcccaggtatgtacgagatttttttgtttcttttgacagagtctcactccgtaacccaggctggagtggagactgcaatctcagctcactgcaacctctgcctcccagattcaagcaattctcccacctcagcctcccaagcagctgggactacaggcgtgcaccaccacagctggttaatttttgtatttttagcagagacggggtttcaccatgctgcccagattggtctcgaactcctgacctcaggtgagccacccacctcggcctctcaaagtgctgggattagaggcgtgagccaccatgcccggccaggtatgtacaagttttagaactgttatattttactccattttttgcctaataatgataatgaccataatgtctattttgctggaaataaattaggtgtctaagctttttattgattaatccttttcggaaaatctgtttccattttcgatatatgtgtctttatgtatttcttaaaaacaatgtattttgaattttgatgctttattctgaaaatttctacatttatatattaaatgtattgagcaaatagttctaggactacagatgtattttttttttctttttcttttctttccttttttttttttttttttgaggcagagttttgctctttcacccagtctggagtgaaatggcatgatctcagctcactgcaacttccgttccctgggttcaagtgattctcctgtctcagcctcccgagtagttgggattataggcacccaccaccaagcctggatacttttttttgggttttttttttttttttttttttttgtatttgtggtagagaccaggtatcaccttgttggcagcctggtctgcctgccttggcctcccaaagtgctgggattaaggcatgagctaccacgcccggccgctggtatttttctaccatctatttttttctatttctatttttctaccatcttttcttttattttatgctcatctcacatttttctgttttgttttccttctttcttgctttactgcgtactgattgagaactgttccttttatcattctttgattgtttcccaggtggatgctccattagtggttatccttgacaatttattacagcataaagtcgacatttaatcactatctctaccctctttctaaataaaagggcttgtggctgtaactcccctccatattgtttttaatctagtattttagatcaacattattttaaatgaaattagatattcttatatattttttgcaacaaatgccttttgtatttaaaagcttaactattttttcatcatacttattgcatctaaaacctttaaaacttatttttctactacttctaattcttcatacttattttagacatttttatagtaagggtctattggggtaaaatttcacttttttttcactctgataatgtctaatttcctcttactctgaagaactaattttgttgagttcagaattctaggttgacggtaattttttcaatatcttgaaaatattttccattgcttttttattcttattcattgttgtagataagaagtctaatgacagcctaaatttaattgctttgtaggttatccatctcacctctagctgctaatataaatttgtctttggatttctgcactttcactgtgatatgtctgagattggatttctatttatttactttgcctgttatataatgtgctttctgtttaagtggtttatgtcactggctcttggaaactttcctttaatatccttcatatattactccatctccatttctcaaaaaaattatgacatacaagaaagctgtatataattaacatacacaagttgctgagtttggagataaatatacactgataaaaacattacctcaatctatgacataaacctattcatcatctccaaaactttcctcctattctaatattattattattctgtaacagaacacttaacataaggtctatcctcttagcaaagtttaagtaaatagactaactataggcaatatgctttacagtagatctctaggaattatctatattgtataacctaaacattgtacccttttacaaatatctctccatttttcccttcccctagcccctggcaggaagcattccacattctccttccattagtttgactgtattagattcataatatgattgggatcatgtattatttgtctttctatgtctggcttacttcatgtagcataatgtcctccaggtttatccatgttgttacagcgaaatggtaggatttgcttattttttaagggctgaataatatttcattgtatgtatatatcacattttctttttcctttcacctgtcaatggacatttaggttgtctctatatctttgctattgtaaataatgctgcaataaacaatagagtgcagataatctccttgtgattctcattcaatttcctttggatatatccctagaagtggaattgctggatcatatagtaattctatttttaattttttttttgaggaatctccatactgttttccatagtgtcagcatgaattaacattcctgccatcagggtacaaggggcccttttctccacattcttgccaaacttgtcatctcttgattttctttttaagtaactgccattctaacagatgtgaagacatatatcattgtggttttgatttacatagccctgatgattaatgagtttgagcaccttttcatatatatgttggccatatgtaggtcttcattgaagaaatgccttttgagctcaactgctcatttttaaattgggttatataatttttttatattgaataataataatctccattttctttattctcctctttgaaaactcccattgagataagttatatgttcatattctactccccacccctgtatctattacctattgttcacatcttccacctccttagtttttggtaacacagtctgtacattctcttttagttttcttttaaatcatttctttcaactaatatgtttatatatgatatattcattttctaatttttaattgtagttgtttaattttgatttctttattccatttttacaatgttttcttttttataacttcaataacatttatttctataatattttacctatttattttatactatacatcttgcaattctaatatccggaattctagaagtaaactcaccgttcgttgtataggctgactgtgcttcatgagggcttttcttgtgcgtgtgagtgagtgtgtgtatgtctatgtgtttatgatgagctcaagttcccctgagtttaatctgtgaggacactgagggcacttttcatggtaaacaatttgcatttgcttctaactaatgctaggacgctcctaacctggtgctaccctgacttaatcacttgtttggatatttctttaccctttgtgataatatacactcaagagttcctcaccttacaagaataggccaacacacattttcaggtgacattattataattattctattactttgcactcacagtgagaagacagatgtctttttatgtttgttctctctgcagatagaattctctctgcccattatcttactgatagaaccccagttttatgtggaatctgtgtttagctccaccattttcgtgagccagaggatcatatttcttttccatcaaatgacttaattcacctaaaattggggttcccagtcttagcttttatctccaccatacaaatgtcagtggtcataggcatgttacggcatgacttcagtttcatctgatttttttcctagcctttaaaggtttacttatacttctttgaaagcaacataaaatacaactactagacattttccagcatcctagtgctttccagagggcattacagaagacttagctgtcctagcccttgagaacagaagtcagccctatcacaacaactgtgaagtaagctaatcaaatctatttcataaagcaaatgtgggatttaagtttgatgttgcttctaacggcttagcaaaaggactgacgtaaaactgtgctcaaaaagtaatggcttttactattattatagacagatattgtctacaaaacatattgacaaattaataaagcataatatgccacttattttcctagattactttatagtcttccttcaagcaatgttcttccgttctggtctatctatgctaaggtagatgtgacactgagggaaaaattcaaagtcataattaccaggaaaaattaatacggccctctctgagtctatcataaatgttactattacagaagaattaaccaatttagattttgtccctttcagtaaatttgctatttcatgtcaggcataacaacttacagacatctttgaaagggactgaaatacgggcattaataagccacgaaagaggtgaaataatcactcatcaagagaagtggtaaaggctttggacttctcaatgtgtgactttaatatttaagactctaaattttattttaattagtcagccataatacttttaaggccatgttttaagctttccttaaaaacggggaaactcgttaattgccatattcacttattagcagagtttttatttttaatatatgaaaagggtcacagagattggaggtagtgtagccaaatggtcacgtgcctaggcttcaagtgtaaagagatgggtctaaatgctcaatagctttttcctagggcctttaatatcctttcaatttctgtagaatgggaatatgaaaaaccatatatcggccggatgcggtggctcacgcctgtaattcaagcactttgggaggccgaggcgggcggataacctgaggtcaggtgtttgaggccagcctggccaacatggtgaagctccatctctactaaaaatacaaaaattagcctggcgtagtggcatgtgccagtaatcccagctactcgggaggctgaggcaagataatcgcttgaacccgggaggaggaggttgcagtgagctgagattgcacccttgtactctagcctgggcaacagggaaagactccatctcaaaaaaagaaaaaacaaaaacaaaaaccaccatgtatcataaggctattgtgagaactaaatgagaaaatgcatatctgacaattaaaagggtacctgagcctctgtaaccaaatactattaccaatattattattcattttgttgtattactaaatcatcttctgctgcttggttaccctgttagagaataaagctattacaatagttgtaaaaatgatatgatttggtacgtctgttggagatgttgcctggtttgctaaccatctttcaaatcattactgtgagtagaaaatatagtgctatatgattatcaagaatgaaagatgccttttgaagtgatggaaataatttattacttatttgaatgcaaactcacactctgaaattagggatgggatctagcaaatctcttttaaatattcataggcaataaaagtctggctgtttgactgatttaacaggcaattgaatgttaccttagttctgcataattgcagctataagaaacattaggtaggtgatataaaaacctcacaaacctctgacataggcacttaattgattttaaaaaataggttaaggctcatcttcaaattaaaaggcactttgtttattaatagcaaatctggctgaggcaggagaattgcttgaacccaggaggcagaggttgcagtgagccaagatcgtgccattgcactccagcctgggcttcagggagagactctgtctcaaaaaaataaaataaaataaaaatagaaaataaccacaaaataaaaacttttttgtttaaccaaccaaaaatcaagagaatcatggcctaaaacaaattcagaattcttgattataacacattaatgtacaacaagaattttttaaattgatttaaaaactcagttactgtaatcattttgtttcttcagcctctcagataatttatcccaaggcttattctactgcatcgaaacaacagtctttttaactagatagtggaaatatccaaaggattgatttagctaataaattattaggtgtgtcttttttacctaagtagtttgaaattgatcaaagtgctgagcaaagcctgagaaatacaaaagtcctattactacacattgttttaatttaacattgtatctttcaggtctaatcagcttatcacaggctgatacaacagaatttgagaaggatattatgtttaacatgatgtggttttcatgaaagccgtaaaaactaaatatgctttattttcattgtcaaataactcccaggttattactggccaaatatgtaatataaacacagctaggactgataatagtttcaagtttacttattttagatttattgttattttaacactctgcttaatcattgaggtacaagtggagagcttctgattttaagacttagagggtgataaaaatcctttttatctgtcttcacattttatttaactaatggaggcatgtgcatttcattatatttcatattgcactatctgcatttatttaccaatcactgccctcagtgggatatatatatatgtatatttacatatttttaaatatatatttacatattttaatatatacttacatatatatatatatatatatatttacacccatacaaacacacacacacaatttttgagggctgatactctagaatatcatctagtcaaaataaaaaggctgatcatgtattaaatttattgaataatttattgaatatgtactgtgttcctggaaccatagtactttaagtgccgtattttatattttgctcacaaaaaaaaccccctatgaaacaggatgaggaaacgtaagtttaaaactgttactcaaaatcacatagccagtgaattacagagggatttgccagttatcaattttttgcctttcaacatgatcctgtttttgacacgggaacatttctccccttgccagctgacatgatattaagttctgtcagtaaaggatgctggagtgacaatgggggaggtagaggtttgtctgtcccagtgtgcttttaattctttttcaaacctgtgactctgggctggcctatggaatgcccagtaaggctcacctcatccaccccactttacccagaagactttcagcaacactatgggtcgtgtttgacaagttctatgggtacccaataagcaaattgaggatgggtggcaaatccataggcagcttcctggagccccacctcatttcctcaagtttagtagcatccactacaggtagtttcccaccatgtccaatgaatacaccagacagctttctagcaaattcaatggttccccaccataggctacttccctgtgaattttgtcagcattcccctccaatattctcttcacactagcttcagctcactggctatagacttgttctggattgggtcaatgaaggaaacttctctgtcatcccatgggaggcagacacacactttctaaagaagtttgaatccagccttgggttgagctcctatctttccatattagttccttgtttgtgtactattcctcaggcttaaggtattctttagagatctcttttatttcctattaaaaattaatttccagtaagtagttaatacttatttgtgttaaaccatctctgtttaagtgactgagtggtttctgtgccctgtctggaccctgactactaatacaaggtgttattctagcccaagtttcaagtattttcttattcaaaagtttatgctttaaaaactcagtccagaaaataagataatacgtgttgaatcagggtatgttgctgaaatgaattattttttctttgggggaaatgtcagggtttataccaaaaacctttaaaatagaaggttataagtagttttgtgttaataaaggattgcaatataattacattaatagagttaataccaagatcaagttagagagtaagctattcctaaggacagaatagatgagtactgaaaaatgtcaaacactgaagttggatcttggccaggtgtatctcccagcactttgggaggccaaggcaagtggatagcttgagcccgggagttcaagaccagcctggacaacatggcaaaacaacatttccacacacacacacacaaataaccgggagtggcagcatgcacctgtagtcccagctactcaggaggctgaggtgggaagatcacctgagcccagggaggtcgaggctacagtgagccacgatcatgccactgcactccagtctcagggacagagcaagaccctgtctttaaaaaaaaaaaaatttgagtcttttcacagctaagccaaggtcagtttcacaatgacttttaattttttgatgcaactgctgtctcctacctgacactgatattcaaatagaaataaaaacacattccaattccatatcacaacccacattgaaatgatcttcaatttacttgccacatagcaatatctatttgactcagatccagcaatagtgcaacaatgatgaaggaccagagattgtttggaattccccttttccaatccccaattccttatgttgatttggataaaatatggatatgccacccaggattcaagactggaggtgctgctggtacatttgcagatatctgccctaccctcacatacttctcttcagaattggatagagaagaggttttcctactcaaggcgttccttttcaatctgtaagcatgtcaaaaggtccccgacattgactattcaataagtcattagtcaatggtttcatgcatactaccctagttactacccccccttattctcttttttctcttcatacgttatattatttgtttttatgtcttgcacattctaggaaatcagtaactcttccttaactaaccaatgtttttaagttatgaaggttagcaaatttttcctactcatcaaaccatagaaccatatctcacatgtagtagatgtactcagtaagtgaatataaaactaaacatcattataaaatgggttttcttcttgacaaataatccattcttaggagatagtatgcaaaacactgactaggagaaatttgctattttgttttagttttgatttgaaaaatcacaccatgtgtgatatatgaaaatttatctataagaaatgtagtgttatttatgaagaataaataatatggggtactaacagaattgcatgtattattagcagattacatgtgacataacaaatgtgtgtggaatggagggagaggaataaaatgagacagcgagagagaaaggatacccacacatactggtctatcttgagtaaggaaaagaactctgtggtcagagtaaccttcttgggatgtctcagttgccttttaagaatcctaacttacaatgtttttgtgaaatcacatgctataatacacatgtaaagaatttacccagtgtctggcattggattgtctctgaaacctgaaagctgagctaatatttaaactattgctcattttatctgagaggcctgtatctgctatacattaatgcaaattagattaaagagatttttcacttatcttcatacctcttcatgtagttccctccaacgagaattaaatgtctcaagttcctcattgattagctcatccatgactccgccatctgttagggtctgtgccaatatgcgaatctgatttgggttatcctctgaatgtcgcatcaaattttcaagtgactgaaacacatttgcaataattactatttctccttttttttctaaatacattggattatcagcaaatgctcagtatcttctgatttacatataattaagtcataatcaatttaaagcaaattttaattgggattaaaaacaccaaggagcatttttgcttcaaaaaataggatgtcattctatatgaatcttcatgggattatgacagtgttgcggactgagaacttaaaacttgattcacaaccacctttttccttgacgtcccctaactctaaaaccagaagaggtaaaacactaaatttctcaacttctctgatagctagtggtgtccacgtgacacaattctgaaaaagagtactctctcaagaagaatccttttgcccttcctacttttttgcacatacatggcctggaggtataacaatcatctttgcactgggaggcaatgactttgagtgtgaggtccttcatgctcaggaagagagagcagagagtgcctactcgcctcataatatggctgaaccatcctcaaccctgagtaacctcccttcactattcttttcgtggtgagaaaagatcattttgtgagcttaaaccgttgtctgattctctgttacgtacatcccaataatacccatctcctatactgctcaaaattgacaaagttgcctggctagataatatgatgaaagtgaatctcagtgtcataggcatgccagaaaacaagggattcaatttcatcttactggacctcaaacatatctataaaataagtgatgggcatatgttctcacaaatttattaaatcttctgttttccttgttttaaaaaaatgaaaatcttccaatacatatttgtaatttttcctgtttatgtatttttcttgaattttgagcaaactcaatacattgtcctattaagtttcaagaaaataaagagacttcctaaatacatttatattaaaaaaaatcactataacctgtaaaatactttaaaagccatcaaatttttgagtagaacaatgtgattgttaataattttcctaataatttatattccttattacttctaacaaatcttaattttgtaaatatttatttgcaaaatggatataaataattttaatggatacattattttataagtcttaacaaagtatataccttgttaaatttttttaaaggtggatgaaaagcaacaaagcaaaattaagggatcagttataaatatcttgagttgcaagaaaacctagaagtcgtgcagtttttctatccttgatacgtggtgatctagcccttttcactcaaaatgtcctcctggataagcatcagcaacactaccaaagagccaattttatgtatgtatttatttattttttcactgtggaatttcatttattggctccattatctgaattaggaacaatttgaaattatgaccacaacatagaaataaaagataagagcactcgcaattttcctcctccctgcttgtctgtgttgtgggcattgtgagggcctcgtctaaaatagtaaatagtaatggtaagttttgtttccccatcttttctaaatgctcttcattatggcttcaaattttctctctttccttaacattcctttgtgaacatgccctagtttttcagcacatcactgaaactgtgagagcaagaatttagcatggtgctccatgtacgatttgacaatttcataggctaacagcatcatcctatcttctgttctggccactgtccttttattaatgtgctgtaaatttgctgcaacttttctagaacatgtaacacattgctgattcacaagaaatgtttggtcaattaacttctctgaatacgacaaatttatagtcatagtcagatagagccaaaattaaagtccactggagatctacttcattgtactttaatatcttttcaggttttataatttccttttgaaaattaggaagttggataaaatgatctataggtgtctactctgatgttctaggattacaaattctattctgtctaaagaaataccttacattttcttcacatcttgaataatttatgctccttattttatagatttacagaggggctatactacttatagctttacgtacatatattacatattctaaaacaacatattcattacatatagataagtcaaaagtacactaaaatgcatagagcttgaatgattaaatgtcagaagttaaagtcaagtttataaatgcaaactcatttaattattgaaagtctccaaagtaaaacttaaaaatgtacttacattttatgaatactttaaagatatatttccaatattaaagcatatccatttaataactcaaaacattccgtaaggtgtaaatttgtgattttaagtaagtataaaataggttccaattcaatacgtgcagcttttaaactggaaataatatttcatattatcatcccgattagccctaaagcagtgagtttgtttattcacactgtctttgcaggtttgtggtacatttaattaggtgaagcatctatgtagaacttagtgatataataaaggcaaatttcctctgtgagaagccatttaaaccctttgcaaaatcttgtgacctagaaggttattagggggaacaaaggctttatccaaagtaccagtgctgagtgataacatagtaattatactctcttgggttgttttctttggatttgtcttctatttggtacttgacctcttttaatactgcatataaattatcatcatttggcttaatttacaacttacatctagcacctcagagatttcctcagctccgccaggaatgttttcagtggttttaagtttaaattctacttcatttagccacttgtttgctttctccaagtatgacaataactcatgccaacatgcccaaacttcctaagaaagaaatatatatcacagattaaatattatggtagaaaagtaaatgtgaaattttgccatttcattattaaaacttctgaaaatataacactttgtatttttcacctttactttgtagcaggtaattcaaaatgcagctagacagtttcatcatctaatacctctacaatcaaaagtcattaagaaaacattttattacatgaataatgaataaattcaaaagacagtaatttactttttaaaataaaaataagcaccaacattgcagtctgggaaacagaaaaataaaagcatatgtaaaaatgcatatgtaaatctaactccctcacacatcactgttaccagtattctgtgacctcctctgaaatttatcatatataatttgatagttaaaatttaagtgagtttaactatagctctcttttcactaaacattatatcataccattttctgtattactaagaagacatatttttaatgaaaatctaagacttctttaaagtggctctatcttagtttagcaatttcctttttttagatagactacttttagttttgtttgctattataaatttatggtaaacatcatcgtgaatatggactatttttccacattcttattatttccttgaggtatattatcggaaatattaccactaattcaaaggtttgattattttaaatggccattaatttgtattatgaaactgatttatacacagaagtactcataaaaaagcagaactttaaaatttctacaagaaaatatagaagaaaatatttctgactttggcatagagaagaatatcttaagtaagacatctcgtaaaaaactgaccgtaagaaaaaagagatgaatacattcgactacattaaaattaggaccttctattcatcaaaggacaccatcaagtaattgaaaaacagactcaaaatagaagaaaacaactgcaacatctgtaacacataagaatatgaaaaatgccagcaagtcaaatagaagatgaataacccaatcgataatgaaaagaaaacctgaaccaaaatcttaaagagaaatatgtatatacattaaacatgaagatatgttcaatctcattagtaatcaaggacatgtaggccaggattacaatgagataccatgttgattgacacaaatgagaagtttgacaattccacgtgtgagagaagatatacatgaacaaaaatttgtatttattgttggtgggtgtgtgtactgaaatggccatttcagaaaacaatttgttattctcaataaggtgaacattcacatacccatcaagacaacaactccactttttgatatgtgcatcctcagagaaactgtttaacatggataacaagactgttacaacaatgatcatttcagccctttttgtagtaatcaaaaaaaaggaaataatgtccactgcaaggagaatggaaaaatataccgtcatctttaaacagagaatacagacgtgacaatgaaaaatctcatcaaaaagaaccataagaatgaatctcagacacaaatatgttgggtgaaagacaaagccctaaaaaaactatattatagtttaccattactgtaatactgaaattaagcacaattgttttttcactcatatgtgtgtggattttttttaaacaaaggaataacaaaggtagctttctagatggtgattatgtctattggggaaaagataggaagatgcgagagaggataagaatgtaacaacggtcattttctgttagctttgtaactgttgaatgaacctataagtacagtaaacacaatgcagcaatcatcaccacttactaccacctgcccccgcctcactaccaccaaaattaaaggcttgaaaggaagatttatttcagaaggatctaaaaaattaatcagatttcccaaagttctctatgttcatagcccttagaatgacacagagtattcgatctctatctgatgaaaagtatcagtctcacctgcttggcaaacgtaccaacctttcatacctgcttgatatcttatgtacagtttattgcaaaaagtgaaattaagtgttttgctttaaaaggtgatagaaatctaaaatctgggtcatttccagctcctgctggactacaggctgtcttcattctgggcaaagatcccagtgggaaaatataaatatcttcttaaatacccgagggtaccttagagctttgaagacaaggagacgtgattggtaatgtgtcttattaactttggtgcagattgaggtaatgaactaccttgctgatttaactgtcagaatggatagcttcttctgtcctcaatgcatctgaaggacacagctggagaggctgaatgtaccagctttacaggtcacctttgcaaaataaaatatagtcttgaagcccgaattggagctaaaagccacttagaataactgttaagcttaacagtttggatcttaaaattactttgaaatcacagaatccaaagtggctttgaaggaaagtacaaataaaaaactaaacttctgttcaaaatagtagatggagctgatgaggtaactcccaacatatcctgcttcagttataccaaaatacatgttaaaatacaaaggaaacatttttaattcatagctgatctgtaaaacatgtatatagaacctcaggtgtgagaaagaaaaagagggaaatgaaagtagaaagtggaaaatcaagcttataaaaatactggcgtatcagaacagggtatacgacatcaaagctggggcatttaacactaacttgagatgggaaatgaggcaagccagggaaatgggaaagaatgaagcagtgtgccatccaccctgtaaggaagaagtagaacatccctagccattggaatattatgatttagcaaggaaactattgttgggggattttgggctgaaaaataaagatccacccataacaaacggaaacttaagcttgtatcacacatgagggcagagcataaaatctctacaatcctgatggcaacaatacaaaaactcaatagcccagagaaaaaaaaagacaaaaattccagtaaaggcaattcctattatagatgagctcgcaaataaacaaataaacaaacaaaaaccttactagccacatggggaaattcacttccattagagggagtcattagttgtaacaaatggtagaatccataccttatgacataaagataatagaacaattttggagaactgtacaataaatatgcctagcctcatggtgtatgtttcccatagagtttatttgcttgagactggcaagtggaattcacacctaagaaaaagggcttggttgcctacatttcattttgggagatcatctctttcttgttttcacaagccctggtttaaacagagagagctgacggagacttgaggggagtgaggtgaagagagtttgaatagttaggcaattcttctttctcacccttttatggggataggtagggtaaactcatctgaatcattttatttacaggatctaaaacaaaaccactcatctactgggtggatatattcaggaaggggtggttggtattcatttcctgttgagctgttggtatggccaagaaggaatcaaaaacaactctttcaaacttctcattcctgaaaggtacggagtataggtacttccagtgcccataggctctgagttgagatatggtaggtaaattagactccagggcatcactaaagcattggttaaaaagacataatattcaagagcagtttgtgtaaagctgttgacaagcgtcagcttgaaattcttgttaaacactacgaggtactataaaagcctaggagatcttttttggggggttcaaagctcatatgaataaggccaatctggatcctcaacagagcgaatcaagtctatagagaacgagccaggtcagtggtgataatatatagaagagggacaacagactaggcattatagatgtgtgtgggttttaacaaaagggaacagcagttgtgagcagcaaaaaaaggactttcacatgaagagagtatttttccctcttcaccctcccttatatcgacagtagatctgtatccagaaactgggatggaggaggagactgtgagaccatttattctcactcctgcgtctgtataaattgctgaagcaacagattaatctaaacttgtgaaatatttgattaagttatgatatttaaatttaaattagagtacattttaataactaaaagtgaataaaaagtaatgagatcccagagaaatattgttaaagaagccaactaccaggcagaaggtgaaatttgacagagttgggtgtagttattggaaaaataagacggtgtcatgtttattactcattaagttgaaacatttcagtcaaacagatggtatctgtttaagttgtttaaaggaatacatagaattaatcacaaaaaagaagaaaaccataacaaagaacagatttgtgaaacaactcaataaaatattgagaaatggaaaatatgttttttgaaaaaatataaacacacatacataaatgtagagagataaatatatatacagacaaagatgagactatttctctattgaaggataaattacgccacaggcagctgaagcgagaatttgagagttggaagacagattttagaaaagtatccaaaattgagcagatagagataagaatatagaaaatattaaagggaaaccagtaactggaatataagaaggggatagtcttaatagctctaagaaagttttcccttaggaaggaatgaagagattgggaaaaagaaaatcttcacaaagacaatgcagaaccactaaagaaataacgtatctgttctaattaacacaccaggtgacaaagtataaatgaaagcaaatttacacacagacaaagttgagtgaaactgtagaagacaaaatagggtgaaactgcagagcagacaggacgaagagaaaatttaaaggtaccagagaaaatgataaagaaacaataacttgacagcagatttcctaaaggcaaaaaatttcaaaagacaaataatattttcagtgttgtaggaaaaaaaaaaacctgtccttacataatttcctgctcaactgcatcattatccaatactcagggcaaaataaaggcattttcaatatgtaaaatctgaacacatttgctactcacactcaaggaaagagcaagaaagaaactgaacacagaagcaaagggaagaacaaaaggcaaaactgatcacaaaaactgggaaaatagcatcggtaaatctaaataaatattatatgaaatagttaaaacaacagcagcagcaacagcaattatatggactaatttgggggaaataaggtgaaaatgaaatatgaggcaacaataacgcggaaaacggaagaggtaggttcagagttaaactatgctaatgtttccaccatattattgttagagaggtatagagaaatatttataagataaaataaagtacatattccaaaccagtgaaaaaggactaaaatggaactcaataatttgataacttcaatatgaatagggaatgttagaaatgttattatacatgagaaggaaatggaaaaataatccaataattggtcttgaaaagtttgttattaatacgaaaacttaagaaaatcccttcggaaaatgtactccaatataaatttctaatgaatcacggagtatcatttaaatgaacaacatgaataatagggaacaatgatgcttatttaaggacattaagaacataagaaagtaatagtaggtgttttatttaaacattgtcagaaagcatttcctgggtacaaaaagtccctccctattgtaacatgttagtgaattaattgtggttttcttgagacatgtacagtgccatcagatcccttcccttcccattctttgttatattttatatagcactcacataacactgatacataagatacgtcattatatcctcagaaactgtaatatttcctgacatatagaaggcacttttcaagagtctgaggagtgaattgcatttaaaagaaaagaataaggatgagtaaagaagagcttagaactgataatggagaaactcggatcacattttacaattggaaaatgataatactgtattgggaatatatggggtactttagctacaaatacattttaaaatatttttaaaggtgtactttattattgatctgaatcgtatctttctttaaatatcaaaccctcaacataggaagcaaactaaataatgtttttcaaaagtaaagaggtacctgaacactttattaaccatattcaccaaaataactcagtctgtgtgagggaagggggcttaaagtccaactcatgtgcaatgtctggcagcatcagcatttgtagtggataaagttttgtgccccttggcacagtattttcataagaaaggtcatagcttatttttgatgcaattacatggccatcatttgaggcacctgctttctttatctaaattcagataagcataatctagacagtaaggcccatccataaaagttaaagcagaagttgtgataatacataaatataatgcaaaccatcaaaaaatatagagctggttaggtaacatgtctaacaaagaactctatggggcacggcaattactaaagacaattgtagtaaaaacatacttctctacagaatgcttttccccaaagatacttaaataagtttatgtacatacaaaaataagaaaaaataaagatcattgtctataaatctggagaaaatttataggattttatgacctaataatagtaatgagaattagaagcatagctactcacatatattgagtactaggctaagtagtttaaagagaatagctcatttaattttctcaacaacttatgaattatgtattatgtctagttgacagattgaaaacaggtttacacaagttaagcaaatggcccaaagtcatacaacttataagtgcctgaatgaggaattcaagccaaagttgttttgcactggtatccatgttcttaaccactatgcctcacatatgaccatgtattgacatatcattgacaaagaccaagaaaagcaactgacttccaaagtcttgcatttcccattcagcctagtgcagagccactggtagttggtggttagagtttcaagttccttttttaaggcctcttgtgctacaggtggagcttgagctatgacactatttacagactcagtaaggagtttcactttcgcttctttttgttgggcctcttctttagctctctgaaaaataaagaatgctctcttaatagcatgaaaataactttacatccaaaatgcatttctatgaatcatataatttctttctcacaacatcccagttagaatgagaattacaaaaataaatctaatatgaactccagtctcttccataaatttaagtttagttgaaattggaaagttaaagaaataatttattataagaatacaacagatctgtaacaagaatagactgaaaagtagtctgcatggaggtatggatttgtggtcaaatatatacacattgatataaatacaattgtttggaaaaggcaagaaacaaatatttcaatattaactaggttaaaaaatatttggcagtctagaattgaaatcacttataaattacttggatgaataatattgaaaccatcacaaatatcattatttaagttaaaggatacttaacatagaaaggtccccttgatgctatatttaggaacatattttgataaaagaaagtttcgttcgagaattgaaaacacatgagagaaagagaaaccaaaaaaggagctgctgatatcagaagctggcctgacacccagctatgccttggtcttctcaagtggaaaataaactgtttcacagaatttcaacattggaaaaggccactttgtttccataatggatcaagaccatgacaagatcattccataatcatgtctgaatccagacaaaaacatcaacattacccaaaccacaaaacgcccaacactctcctatcctggttaatatgaacgaacgccgtttctttattaattgcaactttagcctcattctggtcttctctccttctggacaagatacgatacccatatagctatccctacacactaatgacaagcaatccaaagtaaagcttttaaaccctccctcaaatcccctaacacaagcacaaatcctacaatgttttttttttttttcatccacacgcaccccctggcctccatgttgtgtattctccctcattgcaaaaaataatgaacccaacttgttcagctacaagagagttggtggtggtcttcggttgggagacatttacactccttaacttcaaatgcgtacatgtattttagaaacacacacacatacacactgtatctttagtctgtgttcctccaggggtcaaacctgacattagctttcaaatataagtagtttatttatgtgtgccatgtaaaagaaattctggtagctgaatggggaattgagacaagaaagggaagagacatccatatgggcatacttattaatcccagcaaacactgttaatgactagagtttaatcctgttagaaagccctgagaaatatatgcctgcgggttatcccattcaggggtgaagaaattggggtattatttctgtatcatcttccctaattgttaaaggctgttggggaaatgttaatttcccagtacttgcaagcctaccacacaagtgcaaaagtgggattcagtggccacagaaagccctcaagtaaaggaactcaggttctataatgtagaagttgggcctgcatacaatgcggtggttaaggtaagggcttattggcaggatatggataaggtcagctataaaatgcctttgtatgtgtcagcataatcaccctactcctttggatttagtcccacaattccttaaaagtatgcattatgtcagaaaatgcaaattgttttgtctatagaatgcttaacttcaccgattttaattgattgaaatctttagttcaatattctaaataaatcagctttttggcatcactgagcatagagattgtttttacacaaattgcattttgactttagtaattatagtataatcaacaagtttgattaccattcatcatttaatatgtgctactgtgttctgtgccagccatgtcataagtgctacctcattagatctttacccaaaccttctcggatgtgttttgttacctctatattggacattagaaaactgaggttcagagagtttaaggaaatcatcctcagagttatatcctctctttctcatagtttctgttaagcgggtctcaaatgttccatgagctgaagaaggagcatgctgtagtcagtctaatgaataaaattacaatttatgctcattataaataacccaagcaactatataaaaatgtagaatgaagaacacttctttccatggtttttagacttcatatattcttggtttaataagaggctcagatcttgggaaaggttcgaagaacaaacagcaaaatttattaatccaggtacatatgaggaaagaagatgatgatgaatttctctactaggagaaaaggtagaaagctaaatgactggtacagtttctatacaaatcctcataaaaacggtggctcttgtttctttccatgaatctaactatgatatgctctgccatctttcattgctaggatttcacacccgtgcttcttaaagtgagcacccttggaatcactctgcaacttgttctttggtatcaaactcaaacttgttaaaaatgaaaaactacaggcctcacccaagactcactgaatcagaaattctggggtcagggcccagcactctgtgtattaaacaagacttccaggtgattctgatgtccattcagatgcaggaatcactgctgtagtgattatacaaatttatttgtgtatttactattctcactttatgtgtaagttctggtaagcactagtactagagttataatagagtaaaaattaaaaaaaaataaaaccagttaataactttccagagtgtttttcaaagggttttagtataaagttttaccatatagtgattgctgatctccataaaagttttaaagtcagaggttgtttatcaaactgtaccctgggttcttttatgtcaaaaaaactttccttttcaggggaaaaataagttattaaaacagcacttccattttcaggtaaaacacaggaaagaacataaacagaagggggggtctctatttcttctttgagtatcagggagagatgtcaaaataggtctgttagtatcttctgacaataaagaaaaattagctatcaaatgagcacaggtagaagtctggacaaggtactattgctaacctccaggtagtgaagttgccttaaagaaactgtcttgagtagcaggctgaaaactcaagaaatgaaatcttcctgccaactcttccagtggttgttgccagaggcttccagagtttacctctttttactatcacccccatactaaaccaattttgtagctagaccaattatcaaaacatgtcaatcaatgtagacaaatttgttggaacactcatttcaaggatggttttcaaattttaaaaatttgagacagtttactctagagcacaggaaaataagagagatctgactgggttgttggtgacataggcaaatcgctcatagggagagggaagagggccagaagaggcactgaaccaaaggaacccagggataatcagagcagctgaacacaaatgactctatagtatctacttacggatctgaggtagtggccatatataaatagacgcagtgagaaaggaattgagatacaagagaaaaggccatatgagtgacacacaatggaaaagaaaggaaaggaaaaggaaagggaaagtgaaagtgaaagtgaaagtgaaagtgaaagggaaagggaaagggaaagggaaagggaaagggaaagggaaagggaaagggaaagggaagggaaaggaaagggaaagggaaagggaaagggaaagggaaagggaaaggaaaggaaaggaaaggaaaggaaaggaaaggaaaggaaaggaaaggaaaggaaaggaaaggaaaggaaaggaaaggaaaaaagagatgaaatagaataaaataccttcaatcctgtgggctctaccacaaataaagtctgtgactatggctaaatcatttgacctatctgggaattgcagttttctgataagcagagagagaagtgtgaattacacaagtttcaaagtaccttctagctctcacattctgataaagttttcctcaggggtgacctccccaaagtcaaattttaaattattttggtcttttgaaatactccaatggtttttcttgtccatttagaataaaaactgtgatactctaacaaaacccgtttgttaacagatatttgcccacctcctaagacttatctgaggtaattttatcccattttccttccttcaggcagatttctttctcttcccaattagcttcagggtctttgcagaagctatgctctctgaatagaatgtgtttccataaagatttttttaagtggttggcttttccttatgattcagttctctcatattacatacaattcttcataaatgctctataagtcaagtttttctaaaatagcatcctaccaccctcaaatcctgcctgaacattattcattcttgatttcaaaatccatgtttacttctaggcaaattatcatgatttcatttatttttccatttattgcctgctcctcaccacacgctagaacactagaatgtaaattccaaggcagtggtcttgctcaccaccctctatattcagtagccagagggtgtttggcacacagtaagtatgcaataagttttagttgataaatatgctattgctagattagaataattctgtgtttttaatactctagaaatgattatactaattttttcttcattatagttttatacacacataatatttatacatatttatggagtatattagatatttactttcaacatttgactaaagccgtatgacagattcgatatttaaacatctgagttttcatgtgagttactttctgctattaactataatagatatttctgaattaccatttaattatataattttttaccatgtggccctttcacaattaaaataataaataatgagtcatggtcatttatactgtgctaggcattgtgttagaaatttcatatttcatccctctaatgattctgaaagcagacattctgatacccagttcacaaacgaaggaatttggctcagtaagctcatgtaactcaccccaatttatacagttggcatggggccgaactaagttttaaactcaagtatctggctccacattgatttttccttgtcacaatccttgaaccaaaaaaagatctacagtattaatatttcaagtcattctctaagttcttgctagcacataaaaataataattatgattatagctactaattgagcaccaactctgagttaggcaatttactcacatggtagttacaatcaacagttcatacattcaagtgaggaagtatgatgatataaacatgataaaacagaggattatattgactattatattgttgcccaaggccatacgaaatgccactatgtaggttcaagtccaggcttcacctccaaatccatactacatactacataccagtttccttcgtaataagtcaatgttatattttgtcctattgtttcaagaaaagtacatgtaaactcagtcctttctatccatattaaaggctacgggttcaaatatttagtgtttccaaattctcagaaatgccttcaaactaccaaattaacacagtttgttgactacattataaatttgtcttttcaagaatacttttgcacagtttcaacgtacatttacatcagctacagacagttaatgaaatgagttgattctgctctcttaatactacatgatttcaagggaaaattgtttcaaattgtgattttcaattttcataattgaccacaatgcattaaaattaaacagtttaaggttgttaaaatgtatattaaacttgaagctaaattaaaattattaattaaaaatcaacctcttctcttagaaccaggaaagagcagactgtatacaacttcaagcattgttgcatttctttctttttccatttatttcctttgttttacttagtttttctttttttttttttaccttcatctcttcaactgctttctgtaattcatctggagttttatattcaaaatctctctcaagatactcttcttcagcttgtgtcatccattcgtgcatctctgatagatctttctggaggcttacagttttctccaaacctcccttcaaggcctcctttctggcatagaccttccacaaaacaaacaaacaaaacacgattattgacagtgatgaaacattattattatattatttcatcagtatgtaaataacagaaagcttagatagtaatgataaagaagtaaaaagcttatatgcataagaaaataactcatggggatcagatacactcaatttcccataagtgtgaaaataagacatgtctgtttatttggcatacttaataaaatgaacgtattgcccgatgatgataattcagctgtttgtgtgacaatgcttttctgtgaatggagaaaaacaaggctttttaaaataatatgtttcagttggaaaagtaattttattggcatacatagaaatagttattctttgtgttctttcataatgttttactattttaaatattctaagaacttcataatcatgtatctacagaaactctcataaattaaaaagaaaaaacgaaaagtgcataaaacgtagtttggcaattcacaaagaagataatatatggcaatacatgtatataaaagatgttctaataccatttatagttaaatgattgcaaatcgaagtgaattaatgcattttcacatgttaagacagggaaaaataataattaataaagagcccattttgggcagggatgtgggaaaatcaaagtttttatacttgttgagggaaatatccaacataatacaaccttttagatagtaagatggcaaaacatataaaaatgttaatgtccacgaatctgagtcaactgctccattttttgagagtgaatcatgccaaccaaagtgtagagactaacatgtacaatatttaattcagctttaaagaccaaacatcttgaaaacaaacccaaaggtgctttcatgagagattaaattatgacatatatatactatgggatactgtgcatcacaaatacatctttactgaaatgaaaagtggctcaatataaagttttacgtgtaaaatgcaagttgcaaaagagtctgtctgtggttatagaaaacatctgctatttaaagcctcacgcatttttgaaaactaaaactttctacaatggactccattactcattaaccagaaaaatgcaaaacttaaaacatctaaaagaaaatcatacaccttgttacaaggcactctatagtattacaatcattatacatagtgcttttactttaaaaagtaactctattcaaaagatggtattcttctctctggttgaaacaacattatacattttaagtaacagagttttcatagtattaatatataatgcacagttttagtaaaatgaagtgttcatggtactttgcccaatagtaaatatgtgtagaatcactatcgcattgattttccttataatttacaaccattttgagcctaatatagataatacttcattttaggttctttacttacctaggtaaatgtagtacttgatctactacaatgtaaataaatgtttcaccctaacacatctagaacaatatgtcttgcaattgtactagaaaaggtataaatgttattttgtgcagtcaatgaacctataataaacttaagaaaacatgctgctatttttgctattttataaattaagaaatcctgctgctaaatttctacttagaaactctgctctgttataatcttttaaggcagttggtgaagctacaaaaatattagagggactaatggaattcagccaagacttctagtaaaaactatacattcacatacatactttgtgtgtgtgtgtgtgtgtgtgtgtgtgtgtgtgtgtgtatgtgtgtgtgtgtgtgcacgtgctcaagtatggtgagatattgttggatcctggaaattttgaaggcaaaaacgacagcatttggtgatagatttgatgttcggctgtaagagaaatataggagacaagaaaatctcgtgggatttggcttgaataagtggaaagatggaggtgccatttgtaataacaggcaaatttctagggtagtagactggggtatacatcaggaattttgttttaacatgttagatttaatatgcctattattaattgatgtggaggtgttgagtgggcaaatgggtatgcaggtctaggatcattagaaagggtccagattgttaaaaaaaaaaaaaaaaaaaacttacagcaggaacaacttacagattacatttaaaactatggagcttgataagttgacccggagagtgggtggtaatagggggaaaaaaaaaaggagtccacagactgagccctggaacactttcaaatttagtggtcagggcaatagaaccaccaaggatattgacagtggtcagggaaaactaagagataattaagaaagaatgatgacacagaagccaactgaatttagcgatttagtaatacgaattcactgatgaccctgacaaaatctgctttaatagaatagtgaggataacagtttgattagctctcttaattggcatcaagagagaagggaaggagtgaaatggagagaaaggaatgtctgtaaagggaaacgggaatggagaggttgctagagagattgttgtccaattgaggattcttttaaatgacaggagatattacagaataattctctactgatgggaatgatgggaatgatgtagcgtggagaagatgtaggaggtagagggctgttcattagctgttacaatgtccttgtgcagagacaagggaaagggatccaggtacgtaagtggaaaagctggccttagacaaaagcacagaaagttcatctatgtaaacaaagggaaagtagagtctgtgagcttatatgcaggtcagtgggagtactgcaacttctattctgattgcttatattttctcggtaaaacaagaagctagttttttgcagaaagatggaaaaacagactgttagagatctgacgaaagagatctggggatcactacacccaaagagtatactgacccagagaaagacaatgatctgcaagctggcagaaagacatccacgtaacctctaaatcccatttattgataactatttactataaatttaaagccactaataattaaaatatataaccatatattatttacttagaaagtatacatgttttataattctatatatgtaggtttctatttgttttctatctaacaaacatgtacagtgattaatctaggttagatgaggctctatacaccttgaaaagatgaattcatttaattattatatacttatgaattatgtattaatatcatcacattttaaagattgggagactcaagcacaaaaaggttaaacaacttttctagaatcacacaggcagtttatgatgtggatagacttaaacccaggcgatctgatctcagagcttctggtcttacacactgtgcctttccatccacaaaaaaaatattctccagtatttgaccgcgtgtgtctggtttatttcacttagcatactatcctccaagttcatctatgctgctgcaaatggaagaattttcttttttaaagctacataatattccgttatatgcatataccatgttttatttatttgacaatatacatttagattgtttccatgtcttggctattgtaaatattgctgctgtaaacataggggtgcagatacctccttgagatcctgattttatttcctttggatatatatccagaagcgggattggtgaatcaaatgggaattctatttgtaattttttgaggaacctccaaactgttctcccaaatggctgcaccaatttacattccaaccaacaccataaaagaattcccttttctccacattcttgccaacacttagtatcttttgctttgttttgttctgataatagccaccctaacaggtatgaagaggttcttgtggcttttaactgcatttttcagatgattagtgatgcaccttttcatatacctgttggtcatttctacgtattctttagagaaatgactattcaagtcctgtgctcatttttaatcaggttatttttcagttttatttttgctattgaattttagaagttccttatatattttggatattaatcatttgccagacatatgatttgtgaatatttccttccattccctagaatctaaaatagtcaaactcacagaactagagagtagaatagtggtttccaaaggctgagagaggggaaaatggcaaaatgatgcccaaaggatacaaagcttcagttatgcaagatgaattagctctgcagatctactgtacaacattgggcctatagttaaaaatactgtattgttaaaaatattccaagaggatagatcttaggagctcttatcacaaaacaaaaaaaataaataaattaaggggcagaaggaaacttttggaggtgataggtaagtttatcatcttgaatgtggtaataagtctcatgggtatacgcttatccccaaactaatcaagttgtataaattaaatatgtacagcttttggtatgtcagtcatacctcaacaaagtggtttaaacaaaaatagattctcttccatctctaagagtttacgaattatccaatttgaccaagcattttagggatgggagcatggggaaatcttctcaataggcaagaaacagtatcttatatacatgttatctttatttttatgtacctcgtttatatgcccagtttgaaaagtgtacttgacttccagatacatgtctgattgtctttttctccgaaataaatatggctaagatggaaccgctagtcactctagtaagctattccattttgttcttctcttagtacccactctttctttaaaatcacaatgacctacaatgtagctcataacagaaatatatctgaaaacactttgattcttccctcattcttcctctagactatcaacaaacactctccttcagcaagtactgccagatctaatgggatctgttaaaaagaataaaggaatgtgtcatgttaggataggaataatacttctgggtagatgtaagtgtgaaagtcctcatcaaaaatgtaatgaggatactaatcctctgttggatgagtagtttgcaaatattttttcccattctgtggattgtcttttcattctgtttactgtttcctttgctgtgcagaagctagaaactcagatatcataaaaagaaaaataacgattttatgatataaaacatcatatcatatgtggatgtgatgggattcaaaaatgggcaaataatctgaacagttatttccaaaagaagaaaaaaatggccaattaatatatgaaaaaaaaattccacatcggtaatcatcaaataaatgcaaaccaaaaccacaatgaggtatcacctcaccccagctaggatgtatattgccaaaaagacaaaaaataattgttggcacggatgcagataaaaaggaactacactacactgttagtgggaatataaatggtacagtcactgtagagaacagcatggaggttcctcagaaaactacaatatccacaaatatcccctttttcctgcctgttttttttttctacctggacaattgcaatccctacctgcttccacttcagcccttttgatttattcttcttctaataggaatatgcagcaaacttaaaacaaccattttaaatgaaatgaaatgatgccactcctatgcttaaaagtcagatgactttccaaagtacttgacataatgactaaatcatcactgtggcttccatattcctttctgactcattttcccactctttttctcctggcttcctttgagctcctcaaacatgctaagccctctcttgcctcagatgttttctccacttcattttctggcagaattccttgacacaacaaattgtcaagttcctactactcgggtatcagctttaatttcgcctcttcagaaaacactctactgactacccaatagaaagtagttttcctgctcctgtcactctcatttaaagggttcttattgctacattcagagtgtaagcaagacttcaaacaagacattgttgtgataatgtgttaacctatttactttccattttcaccactaaactattatctccgtgaaggtaactacaatgtctattttattccctcacttatatctgatcatttttttagaaatagctagaatctagatttttaaacttatatacataccctttaaaatttaaaataataaccattttatatacccaaaattagatcatgggatgtgaaagcatcttcaaatgtatcagatatttggacaattttgtttcaaattatttatgttttcgcagacattggcatctggtgacaaaaaaggaattatctttaacccaaaagagtgtatcacacacttattttgtctgtagatatttctgtaatgcatagatttacacttcatttccattattctctctggaatgctgaattggtaacaatattcacatatggcttccttgtttttaccgcatcgtcttcttcttctccttgagcgccattgttccttccttttacaacctaactcatttggctacaaagtcagaacatggccagagtgatacttgtaggaaaagcacagatacatataatattctaagattagaaaatggagatcagaacatagcttggatctatagcttttttgctatgcaacagatgagtgtgtttaaaatatatctcttgaacaacaaattcttagtacatataacagacataaggtcttaagcaaagacatttttagagagcctttacaaattgtactcctgtaaaatgtaaaaaccttgaggttttagtaatattgttggttttatactttttttttttggctgatgttttccccttgctctacataaattggtgatgttctttttattcatccattaagaacattcaacaaacaaaaaacaaatacctttcacactggccttccaggaaaacatcaatggtataatctattatttaagtaatattttttttttttcctaaacaactcttctagcactgacttacttcaggagaagaatgtgagctagctgacccagggacagctcatctgtgaattaacagaaccaatgaacacttgtcagtgattgtattagctgagtgatttcccttgacttttctaattttttttttcattttcaaatgtagcttttgccttttgacattacttcttttctattttgaaagtttacttagcagtaaccaaagaccaactgcctctaacacgtaaattgaaaccccttattaatttccaaaaaggtacagtagttcccttgtatctttggaagatatgttcataccaagacctccaatagatgcctgaaaccatagatgatacctaaccctatatacactagattttttcctactcatacatacctataaaatttaatttataaattaggcatagtaagagattaacaactaataaaatagaacaagttatctctcttcttctccctctcaaaatatcttattttactgtgctcaccgattttaggattccaattgaccacaagcatttgaaaccagggaaagcaaaactgcagatgatcggggactaatgtattggtgaacttaaaagtattcattgctttagttcaaaattttatctttcgaacaagaagtatttgatatacactatttttgaatatatcttactatccgtaattgaatatttaaatataagagagatatctataaaatattcttctgtagaaaaatgagaaactcaaatatgagtgtacagtcattttgtgtgtgtttttttttgaaattcagctattcttaatggttactgaatcttaattgttatttaaaactagatgtcagccaggtgtggtaactcacacctataattccagcattttgggaggccaaggaaagagcattgtttgagcccaggaattcaaaaccagcctgggaaacacagcaagaccctgtctctaccaaaaaataacaaaaaattagccaggcatggtggcacacacctgtacttctagctacttgtggggactgagatgggagaattgcttgagcccaggaggttgaggctgcagtgagccgagttcacaccactgcactccagcctgggtgacagagggagaccctgtcccaaaaaataaaataaataaataataaatgtgtcgaagaggccaaacttggaaatgttaatcgaaagttataattatttatcctatttctacatacacatatattagccatgcattttattttgtaccaaatatctccgtgtaacaaatttttcttaatcccattattattatacatttatgttctgaagaaaacatggattggaaataatgactaagaataggatttcattttttagtatgacagttgtgttcaagaaagtcattttaggatcaaaataagatgaatgtgtactatttaaaatatataccatgaaaatatttagatatgctagaaaaaagattaatttgtcagaattaattgtgctttaaagcaaaaacataggaacaaagccttaaccaaaagtaacggtgaagggagacattaggaaatcttagttaagtacgttgaggcaagccacagtgaaagagattgtctatacctgttggcacatgtgatcccactgagtgttaagttctttgagttctgtctcaagtctcgaagcaaactctggctctgcttcattctttatcttctgcccaccttcattgacactgtttagactgggctgaattgtctgaatatcactgactaaaagctaagaaaataaatcaatttaagccagctgaaaaaaattactgccacatattagatatgaaacatagctagaaaatgtaaaattgggactgatggcattgcatatggatttttgtcttttaaaatctgagatacagagatattgatatagatgactgcctaacagtcttgcaaaaatgttcaatggttattatggcatgaatccagtggggaattatttgtattctacttatatcagaaacaaaaggaaataaatttaatatttctggttagaaaaatgtgtgaaaatgatgggcttcatactttattatctttgttagtattttcattttcaaacacaggatactgcagaaattgtttacagtgtaatgggtgtgaaggttatttgtgaggtggatttgcttttttagcttgtattgtaaaaaaatttccttaaagagcaagattgttttcttcctgctgcatgacaatggtataatgaatattatttcaaaatgcatactgtgttatattatagtacagtgcattatagatgaagagaacaacacagtatgaatagtaatttatcataagaaataacaagtagctcaaaggattctttacctttaaattatactgcattttatagtaaaataatgttatcaaatgaggttgagtacaaggcaatgttttgtcagttcctcatttactcaacccagggtttctcaacattggcactagtgacattttagattgtgcagttccttgttctggaggaatgttctatggactgtacgatatttagcagcatctctctcctctacctattagacaccagtagcatctaaccaccacccccaacccagctgtgacaatcaaaaacgtctagaaacattaaaaaaaatccactggggagaggagagcaaaatccaccccagctgtaaaacactgatctaaccaaataatattcatacaaaattattcatattaaaggcatcatataaaaatcttactctgcactgtttcagctgcttttttagaatttctgaatccccaagggcaggccattcctccttcagaaaaacatcaacttcagccatccatttcttcagggtttgtatgtgattctgaaacgagacccgttataaggcattactggtgtgctgattacttttaacacaattcatcattgtgttatgtctaaacacaggcccaaaaacaattcccatgtttaaaggatgtctctaagtagttcttgaggcaaagaatatttttactaagactgcatttttatggtctactgtatgagcactggtgtgtgaagtctgctattgttaaaaatacaaaattactaccaaatgtggttttatgatgttactctcgagaacattaaatcatatccccctctagagaaattttaagttacaaaacaactcatgagaatactaaaaatgtgtccttacagtacataaaacaaactatgaacaataaactcaatgtaatggtgtctttatagcctccctaaacccgaactttcacaaattattttctacagatgacagtttaaatagtccttccagttgggaacttttggactaatattttgtcatcttcaaagacagagcttttgcttttatttgtctgaccagtacgaagtaatgatcaggtaaaaatcatcatcttttatcatttataaatagccagtatctctcacccatgattctttcccgtattacctttttttctgctgttttgccacttctaaaaagtatgattcaactatgctgtctacatgtgttattttcttctgttttacttaaatttacattgaaaatatgtgctccacagaaagtttcccctttaatgtgattattaataataatttttaaactatttatctaagagaacttcaagacgatcaccttgctgttatctttcaagtctacatttgttcttatttcacatcttcactgtccttgttcaggtctttttttttttgtttgttttttgtttttttttttttttttttttgagatggagtcttgctctgtcgcccaggctggagtgaagtggcacaatcttggctcactgcagcctccacctcccaggttcacgccattctcctgcctcagcctcccaagtagctgggattacaggcgtgcactaccatgcccagctaatttttgtgtttttagtagagacagggtttcgccatgttggccagcatggtcttgatctcttgacctcgtgatctacctgcctcagctgcccagagtgctgggattataggcatgagccactacgcctgggctgttcaggtctcattagtgactccattaatgcactggctcgttttgatatctgcctcggtctcacctcattctaattactgatctacagtgatgccagtaatctcctctcctccttcctctcatcttgggaatgttttgaaaacacaagtggaatcatattatttccctctttaaccaatagcagttttttcttattaagtttttattgttattattatcagtcccatcaccactagattaaaactcagattgtaaaacatagcatccaaggacattcactgtctactctcaatccagttttccaaccataatattttattaatccccatatatattgtctacccagtgttgaacttatatcatttaactgaaaatgctgctatgctttctcaagaactctttctttctcggtattagctaactaaattctacctatttaatctatagcagagacaacctatgttccgataatatttcataatcctttttcctagtttatgttggatttccttcctgcctactgtgacaacctttcccatactgtttaatttatttaccatgcaaggctgaataatgctacccccaagatgtcctcaccctaatctctgaaacctgtgagtatattaccagaaaggactttgcagatgtgattacattaaggattctgagatggggagattatactggatcatccaccagggcataatgtaatcacaaaggtcctaattaaaaggaagtcaacacagggaacaggatagggaaaggaaggtgagaaggagaggtagaaagagagggagagggagatagacagggagagagaaattgacactagatgatgttacactgctgactttgaagatggaggatggggacatgagacaaggaatgcttctagaagctaaaaatgccaataaaacagactctgtcgcaaagcctccaaaacagacaaagtcctgctgacaccttaattttagcccactgagactaatcctgaacttttgacttccagaactctaataaatttgtgttgcttgaagttattaaatttccggcaatttgttaggagtgccataggaaatgaatacacctaccttcctccttcactagaatgtgggctccttgataacaagagccatgtaattgtgccctcttaggccactggtcttgacaaataatagatattttcatgcagtatttacataggtatgcatgtacacatatgtttataagtaaagaaatgctatgcattaaaaaatgttttaggtttgcttagtgctttggtttgtaaaaggtaagcacaaaaactaagcagctagactgggatttaaatccaggagcatattgttgcaatgtttttccatcataccataacgttttcgacatttccttcccagcattaacatttgtcacaataattgaccactcaagggacacattacttaccttattgaatattttaggcttttagaccttaatgcaattgttggtttactgtttttctttagcttgagtggttattagtatggtggcactattcaaacaaattaagtcaagggaatttggtttcaggaagaaggtgatgtggtaaaatttaagcatataattacaaattcgatatggtgataaaataagttattactatatattacatatgtaacattaatatacatatacaacaggttacatatgtgatatatattacattagatatgtatatatgtacatgatatataattccattatacacgtatatatatatatatatacacacatatatacatgttatatgtatgtgtgtgtatatatatacatatatatatggaagctaaaaatgccaataacacacattctctttcaaagtctccaaaacagacacagttctgctaacaccttaattttagcccacagagattaattctgaacttctgacctccagaacagtaatgtaataaatttgtgttgtttgaagccattaaatttctgctaatttcttaggagtatcataggacattaatacacctacatttctactgcacatatacatatatggagttatacataatgggatgaatatataatgcaattttatgaacatatcaccatattttatatataatagcacatatagacagcatagttgactcctactttttataagtagcaaaacagcagaaatgaaaggtaatataggaaataatcatatacatactatacattatatatataaaatgattacaatatacctctgtataatgtatatatacataacttttttctagtcataagctaaatgattacccgtatcttaaaagacaaccagactaaatggatgattggttttgaaaattattaaactaaaaacatgtttaattcctattggtaatggtgaaaatagaaaattcattctaaaaacactgagaaaactcctattcttttcctagaaggaataagcaaatcgccatcctttgtaaaagactcatgtcttttcatcttctcactaactttgaaagatgctgaaggtcaaatgcttatgtacctttacagtttacagtgtatcgttagggaaaaaacaagtaaataaaaatgagggtagaaagtaaaatcttgaattacctgaatttttcggagtttattcatttgctcctctagcttttgacaatgctcaaccagctgggaggagagcttcttccagcgtccctcaatttcttcaaattctgattgatatttccggctaatttcagagggcgctttcttcgacatctctttcacagtggtgctgagatagtataggccactttgttgctcttgcagagaactttgtaaagcctaaaaaacaattttttaaatacatttaccctaattgatgaataataattgatgagttttagtgaaattaactgtacttgaaatctatatgattcaaacatgtaaacaaagtagatgatcttctatcagttataaacttctagtggtaatttaaattttacatattatcctaagagtaacttgaatattatttagtggtatttaacactccatatgtatttttctgaacaatgtcaaatatatctcaaaactatatcttacagagccaaaaagttttggtgcatctaattttactgaattaagtatatatattaataactgcatttgtgatacagttaatggagttgaaattaattatactgagctttcaggaaagtaaactctacataaaactatagctaataatattgatatatggaatagaaaaacttattgaacaatctatgtacttaatatattttcaaaaaatgttattctgttatgtagtattatggtgggattcaaggatagttttgtggagaatttataaaatttatttatacttattctgtataacacatgtaatttcttacagtaggatcataactttagacttcccctgttcaatatttactttaatgttacttttactttataaaataataaaggctcatgacaaaaatggaaaaaaaaaccagaactactagtactttatataaattttcaatttgttctatgtatagctaaatattaaatatatgatcatgtatgcacatataaacagttattctttcccctataatgtgacctatatcaacccaaaatttgtcaaatatctaagttttatagtttcatagtatcctatgcctatttggtggtacttaatttgtttttttactttacttttttaagtttatttcactttttcaaattgttcccctatgactgattatttagacaatatctagcatataactacactttgagctaggtgttttagtgtgagcatttgcccatgtcaaataattattttttcaaaaacaaaaattgtaatggcttttctagttcaacaatttccattattagttctacacattcatttctagttttccactcctgtaaattatgtttatctctatctacctacctatctaatccatccatccatccctcaatcaatcaatatcctatctatctccagttccatttacatctttgagtgtattctgattatttccatcagatacagatttcatggaaattatattaatgttgtatgttattaggatgcactgaagagttaacctcagtaaaattcatattgaatttacatttccagcagtaagagacaatttttatttcaccacttgcaaattggtacttatatcttttgtgtgtatgcaatttagtatgcaaaaaaaattctcatcttgtaatttttttacttcttcctttacaatttaagttacaattattcataggtttattattcatatatgtctctttttggaggataccttactcaagactttcttccttactcacagaaaaaaaaagattccttggtatcatatttctttaaaattgtctctggtgtttttacaatgtttgtgattgtttccatcgatttttatgcttctccacctaaatttttataacattattattttaaatattttccaaaatttgggcttccccacattttttgaacattttattgtatgtggtttttattttggtgtaactttgggggaaatgttcatatctttttttttagttagttaatacatttcccaataatatttatgaacaattattttctttcctatctttttcagtggaaatagtctcttctgctcatctaactgccttttcttgtgttttctccactcttattcttgcacatttttattcttatgtttaaaagtttactagttctattaggcaacacatttttccagatagactttggaatcattatgccaagcattaaaaaccacaacaaaaggaaacaaaaaaggtgaaacagctaccatttggtattgtagtagaataaatatctaaataggacaatacataatgaaagttgtttaaatgtatttttctttgaatacattacttcaaaaaaatatttaattatccaaaaaaaattctatgtgataaagtttaaatttgaatttttaaacatttttcttaaaatgcacatattatctcagcttctaaatataactaatacgttttcatgtcttcagaaataaaaagttattgaacatataatgtagtattttataataagtaggaaaagggctgggcgcagtggctcacacctgtaatcccagcactttgggaggctgaggcaggcagatcatctgaggtcaggagtttgagaccagcatggccaagatggtgaaaccccatctttactttaaaaatacaaaaattagccaggcgtgatggcacgcactataatcccagctactcaggaggctaaggcaggagaatcacttgaacccgggaggcgtaggttgcagtgagccgagatagcactgctgcactccagcctgggcaacaagaatgaaactccgtctaaaaataaaataaagtaggaaaagtattataaaatctcttacaaattatttctttcatttcccatattagtatatctttcctgatagaaggatgttaaaaaaatgtagctattagaattcaaatgtctcattacattacagaaaattaatgtttaaatttaaaccaattttataaatatagccagccctccatatttgtggattctgaatgagtggattcagtcaactactaatagataatatttgacaaaaataactacatctgtactaaacatgtaagactttttcattgtcactacttcctaaataatacagtataacacatattttcataatatttacattgtattaggcattataagtaatccagagatgagttaaagtatatgggagcatgttcataagttatatgcaaatattacaccattcatataaaggacttgaacatctgtgaattctgatattcataggagttcctggaaccacttccccatggatacgaagggatgactgtacactgattttacccaccagtttgagaatgtgacaggagttacaaataaagaagcaaaggtggggaataaaacaatggtttttctaataatcaaaatcaatacatctgaaaatgcatgctaaattaaaaatatacttcataaatagatcatacaattgttttcaaaaacagcatgtatatatgcccatacatatatatccatagatagagtatatgcataaataatactgtaaagtctcattttcatttgctcaatgggcaaactaccatacttgtcagaatgacttaaattctaatattatttaaaggttatatcaatgtgaatgcttgataagcgtgctttattgttttgacattcaaatattcacagacctgcaattccccgagtctctgctccatgatttcatagtcggtgacactaagttgaggtatggagagtttggtttctgactgctggacccatgtcctgatggcactcatggtctcctgatagcgcattggtggcaaagtgtcaaaaactttatcaaaagggaaaaaagaatgagaatcacttaattgtttcacactttgccatgttttcctaaattgtcagcaaactcaattatattactagtttcaaatattaacaaaattagaaaatctgaaaaatatatttaatatgattatgaagatacattcctgctacatgtgtaatatgccagggaccttacacatattacattaaattcacaaatcagcctgtaaaatctatattgttcaattcgttttataaggtcaggaaacagaaaaacagataagggcaggaaacagaaaaacagagaagctaagtaaattgcccaaggtgatacagatggtatttgcagaaaccgagcagggtccaattgtatctgatactgaaaggctactctctctcagtgttatcatttgccttggaaaaaaaatagtatcattatccgaagaccttgatttttaaattatatcatgtcatgtctaattttactgaaagaacacccatgtacgcatgcttagtatatgtatcaagaactctagtaataaccccataaatattatcattcttaattcttataataaacctgtgagacatatacattgttaatcccaattgcaattgagaaaacaggctattaaagaggcatatgtgtatgtatatacttttatatgtataattatattagggaaagtattatatagagatatacagtatgtatatacaaacaagtttatacgttttaaagtatgtatgtgtatatgtatatatatgaaatgtgacttaagcagccacatggactatattgaaagagattagacacaagattgagaacgctgcagagaactgtaaaccataaaaaggacataacatattttagggataatccaaaagaaattctagaattaaaaatacagtaagtgaaaaataagaattaagtgcatgggtttaacagcaaatttgacaggggtaaatagaaaattactaaatcttaagattcagaaggaaatacctggaatgaagcatggagacacaaaaagatagagaacacagtaaaacggtctaatatatatgcatcccagaatgtggcagaagccatatttaaacagataatggctaataatgtttctaaatacatgaaatcacactgcaaagtcctggtttatatcaccacatcaaataacattatctaaatcatattattttaattgctgggatatgaatgtcatttcaatataccaattccttctacactaaatgagaagaatataggaaagtattttgcatgtatttaatgtagtattcagatggttgcgataatcttagagagtgtgttggcaatggatgctgaaatgttagaaatggataatttttttcaatatgtttatattgcatttatttgggaactcataaaaatgttaagagattatatttaatctgagcacttctgatttcttattaaaagatatttgtagtacttaaaatctgttttaatttacataaataatatgtttctctattaacctgatgcatttattttttatttttccataagttattgggggtaaaggtggtatttggttacatgagtaagttctttagtggtgatttgtgagattttggtgcacccatcacctaagcagtatacactgtaccctatttgtagtcttttctctctccccccaaccttccccacaagttcccaaagtccattatatcattctaatgcctgtgtgtcctcatagattatctcccacatatcagtgagaacatacaatgtttggttttccattcctgagttacttcacttagaataatagtctccaatctcattcaggtcactgcaaatgctgttaattcattcatttttatgactgagtagtattccatcatatatacatacatacatacacacacacacacacacacacacacactcaccacagtttctttaaccactcattcagtgatgggcatttggattggttccacgattgtgctggtgtgaactgtgctgctataaacatgcatgtgcaagtatcttttttgaataatgactttttttcctctgggtagatacccagtaatgggattgctggatcgagtggtagttctacttttagttaaggaatctccacactcttttccatagtggctgtacttgtttaaatccccatcagcagtgtagaagtgttacctgatcaccacatccacgcaaacatgtactttttaaaatttttttgattatggtcattcttgcaagagtaaggtggtatcacatggtggttttgatttgcatttccctgatcattcataatgttagcattttttcataagtttgttgaccatttgtatatctccttttgagaactgtctattcatgtccttagcccactttttgatgggattgtatttttcttactgatttgagtttgttgtagattctggatattagtcctttgtcagatgtatagattgtgaagattttatcccactccatgggttgcctgtttgctgtgctgattgttccttttgctgtgcaaaagctttttaatttaaattaggtaccagctatttatctttgtttttattacatttgcttttgggttcctggtcatgaaatccttgcctaagccaatgtctagaaagttttttccaatgttatcttctagaatttttatagtttcaggtcttaggtttaagtctttaaaccatctttagttggtttttgtataatgtgagagatgaggagccaatttcagtctcccacatgtggctagccaattatcccagcaccatttgatgaaaagggtgtcctttctttactgtatgtttttgtttgctttgttgaagatcagtttgtgtaagtattttggtttatttctgggttctctattctgttctgttggtctatgtgcctatatttataccagtaccatgctgttttggtgactatggccttatagtatagtttgaaatcaggtagtgtgatgcctccagatttgttctttttgcttagtcttgctttggctgtgcaggctcctttttggttccatattaattttagaattttttttctaattctgtgaagaatgatgctgttattttgatggggattgcactgaatttgtagattgcctttggcagtatggtcattttcacaatactgattgtacccatccacgactatgggatgtgttttcatttgtttgtgtcatctatgatttctttcagcagtgtttggtagttttccttggagaggtctttcgactccttggttaggtatattcctaagttttttgttgttgttgttgttattttattttattttttgcagctattgtaaaaggggttgagttcttaatttgattctctgcttggtcgttgttggtatacagaagagctactgatttttgtacattaatcttgtatctggaaatgttgctgaattattttatcagttctagaaactttctggaggaatccttagggttttgaaggtaaatgatcatatagtcggcaaacactgacagtttgacttcctctttaccgatttggatgccctttatttctttctcttgtctgactgctctggctaggacttctagtactatgctgaagaggagtggcaagagtggcatatgcatttatttgaattctagatgattattaataaacaaaatccaaaagggaccttataaatagcagtgaagtaaagaggtatttagttacaatgaagcaaatgattgtgtctgagatgtcatttcagcaaatgatctagaaggagaggggactatgggcagacacatggcggtatgttggatgaatcataagcttcataaaatttggtttaattgaacttgaacatgtctcctctttaacttctttctggtctttctgtttaatgaaaactgaaacacttcagtctctgaattattgatctttttctgtataacttctgatctgtccaacaactgaatctcacaggaatcacttcatattggtaaactataattaaaacatgcatattttaattcctccttgcattccaaccctcatcctagttttgtattaaattcatttgaaactggtcatttcaaaaaatctaatctcttggaaattcttttgtagctttaagaaataaacttccaaagattggtttgggaacttgtccatctaatatagtttgtgaggcaagctggaaaaaaaaatacacacctactaacataaatatcacaatttctttttctgattttcttatgtggaatgtaatgacactatgtaatgacagcagtaattgctatcaaggttcaggaaatgcttgacaaatttgcaacggtatagagtatctcatttaaaccatgcaggccagggaatgccagtgaagaattctaaatctgtttcagataagaagaaagaaaaagtcttatacagaagctaatgtacccaagggcaaacacagtatgagctgccccacctactagctggtgagatatctgtagatgctgcccttgtgatcccaacataggagcagaaatagaccagctccatctacggaaactcactttttttccttttatgtagaaatagagattaataatccaacagataagtttatctttactgacagcaataagacaataaacatatccaatctaataacctaccatcttaaaagacctcgagagttctactgacatcattagactcagcacagactcaggaaaaatatggcctgaagatttaacgtttagccaatatattgcttataaatatgtaacttttttctctaaagaaagtattcctatgacagtttctactattcggctgctaaaggaccactttaaaaatgcagatatctttttggttttattagtgaaatatattcaacaaaatgaaaatcaatataagtgattgcaagcttggaagcacgtgctgtaaattattgggaaaataaaaattaagggctcctatcctgcactactgtttatcttgaaaagtaaaaaaaaaaattccattaatatctagacatttaatatagccatgtgagggatggaagtgataaagtataggcaaactgacatctaaaattatagtaaaggaatacaaaaaagaagttttctgcaccttttgtttaaaaactgcttgtctttaactcttaaaagagggaggggctaaagggaaaagaagagagaaaaaaggagagcaaaggacagaccaagagaggcaaagcaagattcttttgtgataacaaaagagctaagtatgaaattagatgctacattttctaatacacatgagtctatgtcaagggcaaaccactttaactggaaagcaaagtaaacagagaagtatattgaaaattctgagagacataactatcgagataaagagataccagagcaatcggttatatataacactttactgaaaaaaaaaatctctcctcttgaaaaatagaactactcagaaaataggcacttaagcatcagagaatgtacaatagagagaaggaagacgtaactgtgccaaccaataaggtagcaactggctacccgtccgttaagcacttgaaacgtggccagtttgagttgagatgttttgtatatataaagacacaccagatattggacagttcatacaaaaagaatgtaaagctatttccacattttaaaattttaattctaagatgaaacaatattttcaaatgacttttacctgttgatctgttaatgtggtttctagaacatttaaaattaaatatatggctcacattatttttctgttggatagtgcttagatagaagctggaaaaggcacccatgtaatccatttagggggagaaagagatgatatgttagtagtcttaatattgacagcatttaaaaacattagaagtcctgttgtgaatatgaaatcgagtccaatttgaattccccattattacctgtggggaaaaaaatgcactgcacatgtgtgaagaagctgaactaatgacatatacctacttcggcaaaatgctcaacttgagcctttaattccatgccaaccagatcccacctttttcctcattccccatgatcaatctaaagtcaaggagataatgcaatcagcaaaggctccaaactttattaaataacatagaccatgacaaaagtaagcatttctctaaaatgtgaacactgacaaaggtgtcaagaaatacaacaggacccatgcatgatatatgatgattaacatactaggaatggtccttcagataattacaagtgcaaggaagtctgagtataacttgaatttctaatgtcaatatataagttgtttccttagtttgaaatacaaggatctttgtgattgggaattcaatcaacattttagcccaatttcctatcaaaatcaatattctatcctccagtcaaaatatgccttttaattacttcacgcctttttgcttatgcaacttgctctgctgaaagtcgctgctgctcaggctccattctcacaaagggcacttggtgtggtctgacatgagtgaaatagatgggtttataggaattttatctaagatcaccatagaatttgttttataagtcataaaactccaatgaaccaactgaaattggggtcattttcataaatactgctctattattcacctcctggacaactgatttattttccaggtaagtctcatttttctgaccaactttgtgtaagtataaactaccacactacagaaatatttattagaatttaagagtttttttcttttgctgaattttccctttttctaaaagcagctctatccacttagcaatcctattttcaaaatatcatgttaaactatttcatatttaactaacaaataataattatgtgtatttatggggtatcatgtgatgttttgatctatgtatgcattgtaaaatattcactcaggttaattaacatattaatcacctcaccaacttatctttttttgtgatgcggatattaaaatctattcttttaccaattttgaaacatagatttttattaactgtgtccaccacgcagtactagagatcgctacaatttattcctccagtctaactgaaactttctatcatttgatcaacaccttccctttcccaaccttcctcttccccccagtctctggtaactacctttctattttctgtttctataatttgacttttttttggatttctcatataagtgagatcatacagtatttgtctttctttgcctggctcatttcagctagcctaatgtccgccagttctatctacatggtggcaaatgacagaaattccttccttttaaagactgtatagtattccattgcatatatatatcatatatagacactggaatatatttatcactatatatatatgtcactatatatatcagtatatatatctctatatatcagtatatataaatcactatatatatctaccactatgcatatatcactatatatatcacattttctttatccattcgtcctgtaatagacatttaggttgtttccgtatcttggctgttatgaataatgctcaaatggatatggcatgggcaacaaaagcaaaaatagacaaattagattgcatcaaactaaaaagctcctgcacaggaaaggaaactattaacagagtgaagaggcagctcacagatcaagagaaaatatttgcaaaccaaatatctggtaaggagttaatatccaaaatatatagaaacctcaaaaaactcaacagcaagaaaacaaataacctgatttaaaaatgggcaagggatatgaacagacatttctcgcaataagaggcaccaatggccaacagatatgtgaaaaaatgctcaacatctctaaacatcagaaaaatgtgaaaaccacaatgatgtgtcaccttacacatgttaaaattagaacggctactttcaaaatgatgaaagataaatgttggagaggctgtggagaaaagtacacttacacattgttggtgggaatgtaaattagtacagccattttggaaaatagtatgaggttcctgtcacataaattttataaatgtgtgtgtgtgtgtgtgtgtgtgtgtatatgtctacatgtgtatatacacagtatgtgtctatgtgtgtacatacacagtatgtgtctacgtgtgtacatacacagtatgtgtctacgtgtttatatacacagaatgtgtctacgtgtgtatatacacagtatgtgtctacgtgtgtatatacacaatatttgcctacgtgagtatttacacagtatgtgtctgtgtgtgtacatacacagtatgtgtatatatgtacatacgtatatgcacacacaacttgtgtacatatacgtatatgtacacacagcgtgtgtatatatatatgtatagctttaacttggcatttagcgagttttcccatgattcttgaggtcagggaacaattcttttatctcacaataagcacatagcttgcttaaataaacatgtctgctatgcttgctcttgatggtattgataaaaataacacaatttttaaaaggaacatttacaaacagtttacctagtttctggagtgaaggagcaatgcaacagattatgtgtctactggaacaaaacattcctttgcctagatgtattaaaaataaaattttaaaataaaaaatttaaaattttaataaagtaaattaggtcaatttcctgaactgcagctagaagagttacctcacatcaaactttgttttaattcccagtctcagcatcctaacagggaggggtagagactaaccatagagcttgaaattgtggccatggagagcatccttgctggctacccttaaaattttcttctactgtctctgtaagaggtaaaagttattttctttcaattctggcaagaatatcttctgtgctacacctccccagatcatcacctcttcaagggttgaaatgatttttctttatcttatcacaactgtagtttaaggttcaatggactctcctctgtgtggctattctttccacaagtcttcctgcttctcctcagacttgtattgcatttcttcttcacataccagctagagggtgagttttgaaaaaatacaactaagggtacttaatttcctcaattgaaattctttcggaaatgtctactgctcttaaaatccaaacctgttatagaagttctataagagcaattctaccctcatcttgtcctaatctttcattgatttgttacattccagcctttctggcctcccttatgtcttctggacatgccaagccctcattcttcacctttggcaatttgtgtttcttttcatttctcctaatgtcctttctccaacttatcatatagctggcacctgcacattctccaggtttggttctaacatcatctccccagaatcacggtttcagacgccaaagtaattataatctgcaataatattcagatattcaattttattatctttctttcaataagctccatgaagacatattgctcttgattttctccaccatgtatattacctagtgcccagcacttttacggcatataccaggtgttcaaaaatatttcttgaatttattagtgaaaaagtgagcaagactctgttctgaaagcaatctaatggtgtagaacagaagagaatcattttgaaactttagaacagtcaaaacactggctttgtcataactaataatgtcactttctccatttttgcaaaactaaaccaaaccaataaaatccctaataattattttaacatgatttccaaattgttaatgaaataaactcaaattatatgaccaatctttttccttctttacattaagaaataaggtttcatttttttctttgttgaaacaattatctacaacagactagatgctgtgtttctatattcatctagcatataacatgagtttactggttttcagtctctagaaaagtattttatcaactgtcatgggaaacaattccaccccctcatcctcccagacctaggcaaccactaatcttatttctgcctgtacagatttgcctattgtggccattttatatcaagagactcatataacatatgatcttttgtgactggcttctttcactcagcataatgtcttcaagggtactccatgctgtagcatgtatcagtactttctccctttttattgctcagtaacactgccttgtatggatgtgcccattttcttcatatagtcatcactggatggacatgtgggtttcttctacgttttggctattatgaataatgttgttatggacattcgtgtatacgatctagttcttacagcatcccatatccatgcttttagttattcaaaccccattagcttacttgtgatatagttgtaataacaaatactcaatgtgtttctctctgagggttaggtaaaatgatgtataaattagttatgcatagagtaaaaagtgctttgaaaatagaattttatctttttatattattttcttctatcacttatgtcaggtaacaactaccaattccttatgccattttccaacactgatagtatattttaaaagccaggtttttgtgtgaaaaagcaagtttaaaaaagtaaagaggaaataaaagtcagtatggatgcctaggcacttctgttagctcttatttcctgcatacttaatacgtccaaagtactgtggaggaatacaagaaatgagatttactccctggtgccagttcggatataatgcatacacatgtgcaattatttgaattaatttcaaattaacaaaatcaactgctatgtaatttcatatgctacatttttcattccatatatatatatatatatacaccatatttaattaaagggttatttattaatctagacaagcattccaaaagggtgaatagtaaaattaaagatgtgtagctacagtggaagtggggacaatttgtttacatataatagcagtgaaaaagttaggaagttttataaacaatcatcgtttgtaggtatgaaatttaaaaaagagaagaaagatgatagggatggatggatggatggagagctgtatgaatagagactatatattattacgtatttatattgtaacatcatagacaaatctcagttatcaaacattgctattctgaacatctttaaagtaaatgataaaaagttgaactttaatatgattaagaggtatatacagattaaagtaaatttccagtgaaatggctcctttgcacaacaattgctgcatagccactaaatgtatttaactttaagggggagttatgtatgtaatgacaagtgaaaatacattattgttaaatatgtcaatatttgaaaatctaggacatttaaaatattttcccaaattgattttgcagaggcacagtaacaagtatactgaaatccactagagggagctgatactatttataaagttttactacctgtacaggaaaataaaccccttagcaaaaacgactctgaagtacaaaaaaaaaaaaaaaaaaaaaaagtatttatcctttgctttatttagctcatttcatttttgtaaaaaatgaaaagctgggaaatgagaaaagcgttgtgtatcactacattaattctggaaatgatattatatggtgaattctttaaatatttacaaagaaaagcaataggataatatattttccaactaatttaagttttagtagtaaacaaacacatgttcctgtgcttctcatgacaaatttgggacagagattttttcagaaaaatacttttatcttaatgccttcaaacccgattttactcaataattccttttgtgtgcacatgaacacatatatgcatgtatatagtgaatcaaaaccccatttactatttcttaaaggtggtcattcatctgtctctgaaaagaatttttgtcttaaaactaagttgatgagtagagatattttggagcagatactatgtattaacatcatcttattaaagcaattcaggaagagacaaaagaaacatcttgaaaaatttgctagtcgcatggcatgaatttgcataattgctccacttttatcttttatcatcaaaggaaaaaataggatttatgtaattatagtgatccagtagtaaaatgtagcccaaagaataatttgtcctttgctgagtttcagttgccacatgtatgctaaagctataatactcttcagataaattgacagaaatattagaagatgcctagcaaatatccttgtatatacagcgagccagacttaattgaagtgtattcatatgacctcaactgctcttttattttcttctatattcaaaacatctgattttgaaatctacaatcccccaaggagaagctattcccatacaaaacatgttttgtttctcaaagtcacaaaattattatgaggacaaaaaaatctacagacagcttatctgttacaccagtatttcgttccttgttaatacaggttgtagggagaatggttccatttacagaaattattgtttcatgttagtaccttctggatttccccacaaataaccattttggaaaatgtcaagttagccattttaggctttttacttacttgtctgtagctctttctctctggcctgcacatcagaaaagacttgcttaaaatgatttgtaaaggccacaaagtctgcatccaggaacatgggtccttgtcctttctctttcagggctatgctttgaatttttaatcgttcaatttgaggttgaagatctgatagccggttgacttcatcctgtgccatagagtatggaaagtaagtaacacgtttactttgcatacattacattttgcaaaagaaggtattaaaaagcagtaaggcaagtttagcttaatacccttcacaaatatctgataagaaacatccatgacagtatagacaagcctctatcaccagccatacatttaaggataccttggctctttgttcaatatgtatcatcctatataatgatatttaaatttcaagatgacataatttagagcattaatgggtatgaatgcgtacagtggaaaaatactatgcatgaccttaaatcctttccataaatcaaatataggtgtttggctgcacccctcttatatcaaaatgatgtgcgcttgcttcaaattttaagctcactcaatgaacaatattttctctttcatttctgcaaaatataaattacatatatacctacatatatgtatatgtgtatactataattataaatatattttgatacaattatatagattatatacacacatataaaatctatataatacttatacatatgtatgtacacacccaaatataaaaatatatctataatcttctatgttttgtatggtctcattacttctcctgaccaaacaggcaaccactgcttttttttttttttttttttttttttgggacagagtctcgctcttgttgcccaggctggagtgcaatgacgcgatcttggccaaatgcaaccttcacattccaggttcaagcgattcttctgcctcagcctcctgagtagctgggattacaggtgcccgctaccgtgtccagcaaattttttttatttttagtagagatggagtttcactgttggccaggctggtctcaaactgctgacctcatgatccacccaccttggcctcccaaagtgctgggattacaggtgtgagccaccgcgcccagccaattgccactttttaaattacggtggctgtccaggtttcctcttgttgtcctggcataattattagtagcaccctgtttcactctcagtagtaccctggtttgtatgataaaatcacatgaacactgctgtactgtcactagctcatgtggcaactgggcacctgaaatgtggctggtccaaatttagatgcatgaaattaccaaaatatgtttaattctgaagattaagaaaagctaagaacataatctcaaagtttttaaatactgattacactttcaaataatatttttgatgaatcaggttaaataaaatgtactattgaaattcaattaccgtttctttttcctttcctaatatagtttctagaccattttaaattacatatgtggcttgaatttgtggctagcactgtatttcttttggacaatgactttcttcacagaattggaaaaaactactttaaagttcatatggaaccaaaaaagagcccgcatcgccaagtcaatcctaagccaacaggacaaagctggaggcatcacactacctgacttcaaactatactacaaggctacagtaaccaaaacagcatggtactggtaccaaaacagagatatagatcaatggaacagaacagagccctcagaaataacgccgcatacctacaactatctgatctttgacaaacctgacaaaaacaagcaatggggaaaggattccctatttaataaatggtgctgggaaaactggctagccatatgtagaaagctgaaactggatcccttccttacaacttatacaaaaatcaattcaagatggattaaagatttaaacgttagacctaaaaccataaaaaccctagaagaaaacctaggcaataccattcagggcataggcatgggcaaggacttcatgtccaaaacaccaaaagcaatggcaacaaaagacaaattgacaaatgggatctaattaaactaaagagcttctgcacagcaaaagaaactaccatcagagtgaacaggcaacctacaaaatgggagaaaatttttgcaacctactcatctgacaaagggctaatatccagaatctacaacgaactcaaaaaaatttacaagaaaaaaacaaacaaccccatcaaaaagtgggcgaagggcatgctattctctacataaatgttttcatgttcttgtttccagtgaagttggaattgtttcgtatttaatacatatataatttgaactcaaagttttcactgccctttttaaaagtgttattatcatggctgcttacttacaattcatatatatgctgtctttagaaaaaaatacttgagggttagttactatttaatatgtaacaacaggaaaattgaaatttaaaaattggaacatgagcccattagaagaaagagaaaatggaaagaattataccaattctgaacgaattgaaatctgagcttcctgaaaatcaaagtgaaaaggcaaaaaaaaagttaatatttatggaggcattcatactctttgggagagagtaacttttgtattaggagaggctgagaaatttatcacataaattctgtcatggttgcaagactaatgtacaatgccacttattctcattaaaaaaacataaatacagctttcagaggaatgtgtttatgtggttataatggtatgagctgattcaggtaaaataatctctgacgattcaatcgttttggtgggtgaagattaaagacgtttagcaaaatggaaggtgacctatatttctctttcaaatataaatcctctcaaaccagtgctagaaagttggtatatatccatggataagaaataagacaagaggtaaagggtaatattctgtatttatagtacagaaatatatacaaataatttgtatgctagatttacaaatggcagcattggcatctactgtgaaccattaagaacctgatttatatttggccagatggagggctgccatttttcccgttcagggggctatagaaagagccaacattatagccaagtgtgctctgaaaaacaaaggggactttgaaactaataaaacatttgggcaaatgttcagttgagaccttaatgttctgagaataaatcatagaagagatacttttcaactgaagtattctgtgtttaaaaagatgtgaacaattagccattatttccataaaaggatttggtttagttggtcctccagagtatggtatctcctttgagtctgtttattctttaaaattatatgcttatctcatggaagcttttgtatttttcacaggaaagggttcatgaattttttccaattctgataaggctctctaacccccacaatattaaaaaccagttctgccgatcattagaatatgagctaaatatgcgctctaatgttataaaacttctccaaataaaataaaacgctgagaaacatgttataatttatttacctatcactaatctcagcagaacagtatatatatttgcccttgtatgaataatattaagcttatcttgctaaatattttacctaaagtgattcttcaaattaatagacaccaatgggtctgagagaaagagtaaggggtgataaggaggtgacaacggaatttggatgcagtaagagaagtattttcccttaggatgacttcctcaacctccagacaatatttaatatataaaacctctggtgatctccatttgttcctcaaatcaagaccaagatactagcaggtcccagaagtcattggtttgtctcctatatacctgactgattcctgtttgtctctcctctcattcatctgcccctctatgttcagcatttacaatggtcttcattcaggtgcttggcctttattgctccctcttgccatgttccttctgcctggaatcttgcttaactgttctcttacctaattctaacttatcacaaaagtctcaactcaaatgttcctccctcaaggaagatgcccttggtggctgtatcaggttcgtttttccctgttactcattctcccaaagctttgcatcttagtttaaaccactgttcctagcaggaaatttaaaaatattgattccattgtttcatatctctcttctctgctttccgtaaatacaataaaagcagagtccatgaatgcccactctaatattcccaaaacttagtgctatgggctgaattgtgtcttccaaaattcacatgttgaagtcctaaccattggtgagactatttggtgataggacttttaagaggtaatgatgtttatatgacgtcatcagggttgggtaagggtggcggggtggggggctaatcccttagggattggtggctttataaaaggaggcagagataaagagagagagaaagaaaaatagccctcattctctctctctgcatgtatacacacagaggaaagccatgtgaggacagagtgagaagttggttatctgcaagccaggaagacagccttcaccagaagatgaagctgaaccctaccaaaccttgatcctggactttctctcacttctagaactctcagaaaataaacctgtgttgtttaagccaccgagtctgtggtatttattgtggcagactcagctgattaatacactcagtagcattcttaaacacattagagacacttaatgtatatattttatgcatgaatgtactgtgtaggtactattactaactactatatctgaatctcaagaatcggataaggtaacatcagatttttgtggcaagaaataatgtatttggattattcctctgattcacaggaaaagcggcattggttctattcttaaattacaaaatgcatctcaatgtagaaattccttagatgtgtgtatttgcctaacaagtcaagtgccttatccaaggtattctttatccaaaagtatactttctgagtttatttcctcagcaaactaacacaagaacagaaaacctaataatgctacaggtccgatatttgaagaaccattaagtccttcaattgtttttctcttcaaaatagctttgaatttctcatcactttttgggtccaataccttttctaaatcaaccttgtcacctttccatgtctattctacctttatttaagccattcttttttacagtatgcaaatgaatctccactccttgccttttgtattaaatgtaatcatctcgatctatcactaaacgttcatcctggaaacgttttagtccatcctctaatcagtttctcattccccgcgaaaagcacatagctcatagtaacaatgaaaacagtttaggctattttcattattatacagctcttgttttcttacacttgaaggcataatcctttcatctctttctcaggcccttttgtccacttacatcttgtttgcccctccagatccactgtccgctcttctcctgttacccaggagactgatatttacagatgacggttccttgtcctttgtcttacgattaagtttagtcagtgaggagccctgacaagattctggaggcagggaaaaaagtgaagtggggtgtttatttgtctgactccatttctatgaggattccttaagccggccatgctgcttttaccatgaggatctgactgtctccttctgagtttctataactgctctctcactgatcctttctggactaaaaggggtaagaactctgatgctgggttactacactatccggtgtggttcctctgtactccagctacattttaaaaatatctttttgtaaagaaaccttcctcaaattatcgtaatttgagaggtccatcagttttaaatattttccttatgtatctagttatactgcatccaagcttgttgttgacccgtgtttctaactatttccatggattccactttttcaaaatgactatgtttcactcgtcacaaagaaagagttccaaagtgagaggccattttttacaggatacatgtggtttccacactcctaaactgcctcatgcttacgcaaaccgacacaatcaattagcgctgtgtaactacgccaaatacaattttagaatccgggtatctacgtcttacatatttaaacagatttctgttgcttacattttgaactttattgcgcttagctaaatccttagaaggtgaacgtttcattactaaataatttgttactgtcttcttggaaattgccaagaaatacctattgattatgctccaaatggaaggagaagagattcttaccttacaaatttttaactgacttttaattgctgttggctctgatggggtggtgggttggattttcaaccagttttcagcagtagttgtcatctgctccaattgttgtagctgattatagaaagcgatgatgttgttctgatactccagccagttaagtctctcacttagcaactggcagaattcgatccaccggctgttcagttgttctgaggcttgtttgatgctatctgcattaacaccctctagaaagaaaaaaataattaaatatatcccctgaacccacagactgaaagaaatgatctgaaagccaacacatcctaattataaaagtattcaccacatgaatgatttcaaaccagatcaattattttctaagatataaatgtgtaaatatgatttcagattattcaatgtgaattatcagacttgcgtcacaacaatgaatatcaatgccatcaagtaataagacataagatgtagaaaattagaatatatgtaaataaaatattaaataaaaacttaaataaaaacaaaagtgctcaaagctctgatgggagctggaaggctgcatgaacaagtaacattttggatgttttcagatacattttacatatcatacatattactcaaatatacttccccaaactaacttacatttttaattttaaaaatgggcttggaaattagtttaaatagtattttcatagttttaaaaagaggaaaaaaaatccaagattattctttatttcatttacagaagattagaaataaacagattgtcggctgggcacggtggctcatgcctataattccaacactttgggaggccgaggtgggggatcacggcatcgggagatcaagaccatcctggctaacacggtgaaaccccgtctctactaaaaatacaaaaaattagccgggcgtggtggcgggcgcctggggttccagctactcgggaggctgaggcaggagaatggcgtgaacccgggaggcggagcttgcagtgagcggagatcgcgccactgcactccagcctgggtgacagagcgagactctgtctcatattgtccatggatgcgaggaagaaaaacaagtactaggaaaaataatctttctaatgtgaaacatttttaaatttataaatgtagaagttgatctcaaagttttaaaatcatctgtagtaataccaaacccagaaaactttatcaagggaaaaatggaaacacaagcatatcattatcaccattaccattctggagtacctactatgtaccatggaatatgctatgtcatttcatatatgacgaacgccagtccaagtacatattattccatacatagcatgaaagcatggcaacatcacgctgtgctatgggttaaaatattcaaactctctaaagttagtttacaaaatttagactttcttagatttattagcttatatagttttcttaatgacagaatataaaagagaaaatatattacatatgatatcatgcatttttaaacatagctacattagcactgataactttcttatactttggaaatactgaatatttaaatgttttatgttccctcatgtacctacagagatctcaaaagaacataaactcactgtaaggttctttctctaggttaaaatacctaaaagttcgaagagtagtttggtagaagagtaggttgcctaagataatctacttttataaatgttcattttacttaattttctggtaatataatttagttaaagggaagctaagttcttaaaaagtctgaagaacgtctctagaaacataaggcctgtggttttgctaacttgcacatgcctcccactttatcctttttaaagactaaaaaaaatatagatgtgaattcaacaactatattattttatcctctttcacttccctctgccctgatagtctaatgttctatttgtcataatgatattaatgctgccaaaccatgtccctcaattcatttgaaacacaactgtaacttcactaatttcaaagcataatgctactcaggatggcggtgaaggagacaaactttgcaaatattatcgtcaactattttcccctccttcttccctgatatatttttaatgagatacaatggaaataatagaatgtaaaaagaatatatacatggctccatatatctaagtataaaagaagtccgtggcctacaggagctacatattctaatatcctcctaatgcttaaggaagcaattgtgacatgctgtttttgatcgttagattttgaggagtgatcaaaaattgtaccaaaatatttgttaagcgatgcgattaagtaactgttgttataaaatgaccacatttggtataaagtgtaagagaagaatatgaaacttcaatcgtatgagcactccgtttgaaaaaagtattatgataaaacgttaacatttctggaaaataaaaagataattagaaaatatactggacagaatttttaaattatgttaataacaaaaaatgtggcatggatctaaatgatcagatatttaggagaaatattttcagcatatgttgaacttgaacaagcagttagaagtccatgaagggtgaaacgtcaacatgaaccaggtattaaacaggcaaaaaagaaatgctaaattaaagggaccgatagactgatgctggattgagtcttattcaacatttgtctaaatgagacgggaacacagagagaaatcactttgtgtccctgagaaaggtcaaccatacaaatcgtagcaaatgaaaaaatgaaactataagttgattttcaatatggatatgttaattttgttaaatgataaaactacagtgaagtaccaataggctctgcagtatccgttaaaatctagggacaggttttaatgagtcattgttgatcattacacaaaactctatgttttgccccccaaaaaatgttgcaatatatcactgtaaaagaaatttaaatggtgaagaaaagtcagctttgtacaaattcataacactgaaatttataatacgctctatttatttgcatattgatctttataactgaatgcaggcaatgaaaatgcagtgataggtaaaagaacgacatctataatagcaaaaagggggaggcaggcagaaaggcagagaaatgaccggtgagaattctggcgttaaagagaccggagttcaaatttgatgccccttactagatgtgtgaaatgggttcagttacttaatttcactggatcttgtttttctcatccatgaaatgaggattaaaaatagaatcgacctcataggatacttaccaaagttctgagttaacatatataacttacttataacaaatgctgacacatactaggcaacaaagacatattagacaatgccatatagaggaaatgaaaaagaatattcagaaaacaagggaccagctctcttgtgtgaaaattagggggagaggaagtcttcttaatgactgaaacaggacatgtataaaaagttaataatactattttaaaattagtcctaattttatataatatatgactaatatgggatatagaaggtgtatttatacattttttaaagaagttttatcaataaccagggatcctttgagaccaggagttcgaggctgcactgagctatgattgcatcactgtattctagcctgggcaacagagcaagagcctgtcaccaactaaaataaaaataaaaagagtttatttgggaatcctggaatattctgccacatttataatcatgtgagattgaagttataaagaaacgaaaacatttcaaaaaaaacgtggaaatttctagatgttactagaaaagacataatgttgggcacagaaaatcagaagtcttgctatgaaggatttgtatgcaaacattgtattaattcattgtgaatatgctgcctgctcaacaagggcataaactgtccttctaaactataaactcctataggaaatgtctccactggcagtatctaatagaattctcagcttggagtagaaagagtataactacactgtactcatgaactcattcaataccaaatcaatagtgtactctatatgaatataaaaattatgagaccaatgtacactgaagccaaaagccatacacaaacaagcacacaatctctcttgtatcaaatttgctttaaaatacttgggcaggggatggagaggatggtcacgttacttactgacactgtcacgttaataaccgacactgtcacattacttaatgtacctctcttcaattaaaatgagaaatgctattacttcaactttatgaattaattgaccatctaaatgccagaactactgttgattttctaagaaagtccattaaaacctttctagaatgaaaaagggttcaaagcgttatccaagtaaatatttgcatatggattttattattatatataattgttttatatgtattccatagaattatgctccttgactcaatggaaaattttaacttttctaagagtttgtaagtgtaaatatctgaaaagttttaagtatcaatcatctgagcatctgttttctaattttgtgttagctatttaagaatacaaatactaacacaccaggcattatgagcaatacttatggaaaccattttgttgtagcacattagaatctcagggataatggatcataatccattcacatctcatattctaaacaacccctgaaatagtctgtgaataaatatattgcacccagaggaaatggatcattacttgaagtgtatccattaattttattacttgtgtacagtgcataacagactgttagaataatgttaaatgtgcaccaccttccatgcaagtacttcagaactgccacttaaagtgaagtattcctcatcaagtatattcatcattagccatgaagccagggtagaataacacaaaacaagtgtttccagagctcttgaattaaaagaatatttggaatagaaacttaaaataaagctgctaataaacagtctcctatttttgctgaactttaagtgagggttattacaagtccatttagcattcaatgtaatagtctaaaatgtaatatagagatattcaaaacctgtgaagacaagttctgaggctaaattttagaggtttctgtgaccacactgacttaaagtaatagcttttaaaaattaatagtatatataaaagtaatacccctagtgagggcaatataaattttactaatatagcccttttgcgtttttattttcaaacatcataaaattaaaaaaagtcagatttttactcatatttgttttggccactcatttcccacaacaacagtgacaacaacagtctctttctttcacacacatggacacacacacgcacatgtctgcgcatgcgagttcacccgtgcatgcacgccgtgctcacacacacccacagaggctcttccttttggagattagacttaaacgaagaaaaatgtgcctgtcaattaaaaacatttattgaatgtgaactctgtgtagagcattatactaagtgtcatgtggagaaagaagaaatataaatcaaactgcccagtactgaggaaggaataagagaagaggaaatatatgcaactgtggaaggctactcattcatgatgaaggggctgggctactacaagtggtacagtctccatgccacatttgtatacagactatttgcaatatgtcttgccattaaaatatatgattagaagacttgctgctactgaaagtttttccagtgatcatgagagttttagctttgagatgagccagactgaccataatccctaccctcacccatctgacaaaatctggttgcccacctcaaataacataattcatgtgaaattatctaatgagctatgaaccaaaatacaagaaaaaaagatagttacttggttaatgttatggataagaagagctctcgtcagtgttatcattctgtgccatttaattacaacagttagcatacttattatcaggtatcaccttaaacactataatctagcactcagggaatgatagttttgagatgttctttagtctaatatactaataattactacttttatttaaacatgtccttgatgtgactgtccttagactcttaattaacacacagaaaactacaaatagaaattgaaaatgaatcacaatttaactaaccctattacataattatagtatctcctctagaaattatggtgaaaggatcttagagactaaagaacgagaacctgagctacgcctacatatgttttcaaataaatgttttgatatggtcatcttttggtaatttcagtattaatatggaaaaccagtttatctaaactaggcttttttgtgttatgcctgattgatgagactgtatgtactcatgcgagaacactgttttacaaaaaggattacgtctaatcctaaatagataaaaacagacatatgtttaggtataatcatatgtatattattttagccctaggttgtcctaaaactccacaatctcaataatacactgaaaggccttggtcatgaaaggcatcagtttaaagactgttcaaattaaaatcttagaaaaccattattagttagcaatattattaaagcattagaaagattacttactatatttaatggctaaatttttctaaatttctaaattatttataacattttgtatttaaattaagaaatgtaaaaataaaccttaaagttatatcacatctttcttaaaaagtaaaataaagaatttggaaactcccttttcaatatgcacagctacatgaatatataaatacatcactagatacctggtctagcctctcacttgccctcattaagttaacagtttcctgagaccagggttatgatccaaagcttacatattgacggtaagctgcatgaaaattacagctatccaaaaatgtctctagtaaaaagaggtactttgcaccatccaatattctgtcacatttatccaaccaattaatgctgacataagaacagtaaattaattttaatgttagttcaaacaaaaaatacagctaagatagagataaatcagttaaaaattataccaaaatttcatgccaaaatgccagaaacgtgatttttttttttagttaacactctccttttagtagcttctctttttagtctatgatcgtgaaagatcacttctactctgaccaaaagaactggaacatccataaggaaaacgtccatgtatagttttaaagcaggcaaggaatttggccaactcatttctttggttaaaaattccaaataaattagtaagaatctcttacggtcaataaactcttaatatacaaattattgctgtaaaattaatgatatggttaatattaactgttttaaaattctgcatacaactcttcacatttgataaaatacagtgaaaataaaaagtatcttccaattgatcataaaacttgtatgtgacactgaaaaactgtacatatgttactagacatactgtttctagaacgtacaactgatttttaacaatactttgcaccatcaaatgaggttcccttctacattgtaaccatggtaaattttgtactttcaacaaccttaacaccctatcctgtcttctcagcatatgtcttaaattccttcaacaaattgccttcaggacaaacagattttgttttctgcattacttaagtgatgttgaatcttcaatgcttcatagacatttagaaacggacagaaatcatttggaaatatgtctgatgtaccatttcaggtcaaaactgaagtaaaatttaagttatgagaaattattttttccatcttggaatttcattctaaaagcaaactgatgaattacaaaattattctaaatttttaaaaagtagtttaatcttagggcaaattattttaagtagaaaattcagtttgctatgcatataccagtatagatacatataaaatatagttcacagaattttttaaaatctataatagctatacttatgctattctacatatttttacactatgaatatatgttaaatattttcactgtggtaagcacacatcaaatttataaatatatacgcacatatttttattagtggcataataatatgagtggtttatacaagagtggttcatctttatcttaacttctgaggaaactatacgtggttaagaggaacagccatttacatgaggtcctaaatgaagcacactgattcagctctcattttcctttctatacaaaaagggcaagaatgtatgtgtcttacgtggttgtgagatttattatatctccatagcctaagcttgggaaggaagattctggacttataaatttaagagctttaatgcaataattgctggactcctagtttacagaaagcttcatttgtctttcagcttcatgagctacaccactcaactgtacttttgggctctatactaaaggagctattatgatttagggtagcagtccctctgaaatacacctgaaggggtacttcaggcacttaatatgtgtctagcttatctcacaatttgcacaatcacagaaaataaatattatgcaatttgttccttgaacgacaaaaacggaacaaatagataagttagaatatttgagcctttaagtaatttcataaattattttatttaatggggaaacagagctatggtcattttaagtagtcatcctagttatggcccaaacttgagcctaatgacgtatcagttcgaccatatctttactggtagaacaaaagggtagcataaaatttgattaacacagtcaaccaaacaggaatgtctcaaatcacacccctaccccccagtgttccctggtatctgccaaagttagcattttccttcagatggattattattttcacaccaaaattaccaacgttattacctcaacgactgccttaattttgcttttctaaacagaatctggtcaattaatatttactaagcacctactatgtgtcctgacttttctacatgcctccaaaaattagaactatgagggaaataatcaagaaaattaatattctcactagtcacacgatcatttaaatcctgcatgtagttttacttaccaaaaattaaaaatcattcccgtaatttctaaatgtttaaattatttctgattaattcagtgtaggtaagcttgatatataactatgacatgagaccatttaaagtatagctcttgcatcagcttattaaaatgaaaaagtgataatacagtttctagggggaacttacataacaactaggagaatatttttagatcacataattttatttaacatgaatatgctgttaagttgatcagttaaaattaccaagcaacatacatctaaataaaaatctactggtattttcattacctgttcttaaacttgttcactcaagtctcacctgttatatttgtttgttttcatttttaaccaaatacagtcagtcatgggactcattagaagaagaaaatgaattgattttctaggaagaccactgaacttttgaatgccaaatttgcaattaaggcaaaaaataacttatacacagaatttatgccccaaaatgcaggcagattctgaaaaaagctgacatgcacaacaaaaacatttgttgtatttatttatgatgttcttgtaaacgtcttctacaaaatgaaaaataatcttatttggaaatagcattatccctgattttcgtaaaattttatctggaaatatagtagtatagcaatgataatttgaaagaaggttgtttacatatcatgtcaatgacacatttggtacacataacttttgaggcactgagtattagaaaagattaattttaatttattcttgaaaaagaaagacaaaaacttggctagctttgtgcttttatctcactctaaaaaagttacttaaaagtaaaggttatcccgaagagacttcttttttaaatgagaggaagtgataaaaagtaacacagaaaatgtcatatatattattacaaaacaggaatgacggtaaaacattccatataattttagtgtttggaaaaacatattgcaaaaatgatttaaaatcagatgatgatcagttttacacatataacatgactgttaatgttttcaaatttctgttaaccttattttcttaaattatttggataaattctagcagatttgcattaaaatttatttctctgctacagactgataaaatattctaccacatcccattttcttccaatgaactcaaagttgaatttctcctaataatttccttagcattaaaaaaagaataataaaaaacatacaaacaccttttaatttaaatttgtatttaacaagtgcttgtctgatataattcagctgataaatatgaacctatgtgtttatcaaatccctaagaagattatctaaatcaactcgtgtaattaccattcaccatctgttccaccagggcctgagctgatctgctggcatcttgcagttttctgaacttctcagctttttctcgctctatggcctgcagcatgagagcaaagatgagtaattcaatacaaggactgtgaatctacacaataattataacttctacttgccctttcaagccttaagatgtttcactctgtcagcttatcacgtgaatctaaagactttttctcaacacttttgccatcaaaaacatcaaaatggcaataaaagcatgagccattttcatgacttgctacaacttttaattataagatttctactcagcttttttttacattatagtttctgatacatttcaacgcaagactgcaaaaagtaaaaaggcaattcataacaatgaaagataaagtgtcacataactaaaatgaaatttatcttttaaagatacaccattgaaattactaataagtatataggcggtattaaaaatcaaattgagaatccagtatgtatataagatggaaaaaataaactaccataaataatttagcagaaatatataatatatgtacatatatatttaaataccaggctgtaggctaatttttctttcaaaaataatcaaagtactcctatttccaaggaagacaagattgagtttcaaaaaactttctgaattcctttatttcccttaagagttacattttgaaccacaaatgcaaaattatttcagttaacaatagccagaatttcatactattgagtttagctaataatattcctatggagacataaattttaaactatgacagagtagaactacattactataatcatcaagaagtgttgactataacaatgtgtatgtcctaaaacataactattcaaataactataacgcaattaaaatatagtaagaacaacacacctgtgacttaacaatcatattataacaaagatttctcttgaatttgaggcagaaggttattctacatgagactattttttaagacttcatttacatccacaggcatttaaaaaaatatttccaggtaaaatactggagtacagatgggagggcaaataacagatacatggacagtctgcaccactgttgagtataaatttgtgcagggatggaaatgatctgtatctgtgtcatccaatatgatagccaataaccacatgtgggtattcagcacttgaaaggtggtcagcatgacttgaaaataaaagaatatttaatttaatctaattttatttattttaaataatttaaaatttaaaggttacatgtgaccagtgttaactgtgattgtacagcgcagatctaatacattcctttaaaagcaaatagttaagagataggcctgtaatccgagctactcagaaggcctgggcaggaagactgcttcagtccagggatttgagatcagcctaggcaaaatcgagagacctccatctctaaacaaacaattttaaaaaattagtcaggcgtggtgacaggagcctgtagtcccagctactcaggaatctgaggcagaaggactgcttgagcacagtagtctgagtaggctgcaacgaactatcattgcgccactgtactccagcctgggcgacagagggaaactctttcatataatatggcaatatcagaaatagttgcagagaaaaagtaatcatctagacaacactatttactaagcacattaaattatgtaaatgcttatacaataatccacatatttttatgtatctgaaaagactatctaatttaaagaaatagctacaaatgtaaagctttttgtttttgtttctctttgagacagagtctcactctgtcgcccaggctggagtgcagtggcatgatctcagctcactgcaacctctgcctcccgggttcaagcaactctcctgcttcagcctcccgagtagccgggattacaggcgtgcaccaccacgcccagctaatttttgtatttttagtagagacagggtttcaccatgttggccaggctggtctcaaactcctgacctcatcatccgcccagctcagtgctggggtggggcggggggattacaggtgtgagccaccgtgcctggcctgaataaaggttttcttaaaaatttattttaaagagtttcctaagtgggagacctgacgatatctgacttcaaggcttgatataaaactgcagtaatcaagacagagtaatattggcaaaagaacagacaggtaaatcaatggaacagaatagaaagctcagaaacagatccacataaatataatcaattgatttttggcaaaggaaccaaggcaatacagtggagaaaaagtctttaaacaaatggtcctgaacaacacaacatctacatgcaaaaaagtttatctaggcataaaccttacacccttcttttgttttaattacaattatttaattccaatttatttactttcatgttattcactggatcaacttcattggaagtttatacttttgatggtgaaatatctgacattattgtgaattttatcacaaattcactttaaaatttcaacattgaatatatctgtacaaatgataacatgggctgggtgcagtggctcacacctgtaatcccagcactttggggggccaacgcgggtggatcacctgaggtcgggagttcgagaccagcctggccaacatggtgaaaccctgtctctactaaaaatacaaacataattatctgggcatggtggcaggcacctataatcccagctactctggaggctgaggcaggaaaatcccttgaacccgggaggcagaggttgcagtgagccgagatcacaccattgcactccagcctgggtgacagagtaagactctgtctcaaaaataaataaataaaataaaataacatgaacatatatttttgtggaacacagcattatggttgaaaaccatgttttcttggatacacatggatataaagatgggaacaagaaacactgcggactactagagtggggagggagtgaggggaaaaggtccaaaatagtagctattggatactatgctcagcaccaaacctcagtgtcacacaatatacacacgtaacaaacctgcacatttactcttgaatccaaaagttgaaattataaaaaataaaataaaaatgaaaaataaacataccaaaaataaatacatttccactgaatttagaaatttgtgtaactgcttgaaagtaattgtggtgttcatataattcataaagttaattaataatgaatcaatcacagactctagagtaaaatgtaaaactataaaactcctagcagatagcagtggagaaaacagaggtgactttgagtttgttgatagttttttagatacaccaccaaagggatgatccatgaaagaaagaattaataagttgaatagtactaagttaaaaggttctgctctgtgaaagatgctgccaaaagaacgaaaagaaaagccacaggctcaaagaaaatatttacgaaagacatatctggtagagaattcttatccgaaatacacaaagaactcttaaaactcagtaacaaaaacaaacaaactaaaacatgggcaaaaatccttaacagacacctcaccaaaggaagtatacagatggcaaataagcaaatgaaaatatgtttcacatcatatgttaccagggaattacaaattaaacaatgagataccactacacacctattagaatggccaaaatccaagaacactgacaaaaccaaaagccgacagagaaatggggcaatgggaactctcattcatttctggtggcaatgcaaaatggcacagccactttggaagacagtttggaggtttcttacaaaagtaaacattctactatatgatccagcaatcatgcacttaggcatttacacaaaggagtcatatgtccactcaaattcctgcacatgaatgctgcagcagctttgtttgtatttgccaagacttggaaacaatcaagatgttcttcagtagatgaatggataaataaactgtgagacatccagacaatggaatattattcagtgcttaaaaatgagctatcaagccataaaaagacatggaagaacttaaatgcatgttactaagttaaagaagataatctgaaaaggctatatattttaccgcaggatttcaccctagattccaattccgaatatatgatagtctggaaaaggtaaaactatgtaaactacaaaacaatcagtggtttctagagattaggagagaagtgtagatgaacgggaaaagtattgaggatttttatggcagtgaaattacaccgcataacactctaaagataaatacatgtcattgtaaatttgtttaaactcacagaatgtgtggcaccaatagggaaagctaatgtataaactatgaactttgggagataatgatgtgtcaatgtaagttcatctgttgaaacaaatataccactctagtgggaaatgttgacagtggggcaggctatgtatctgtgggagccgggttatatgggaaatttttgtaccttctgttcaattgtgctgtgaacctataattactctaaaaatggagtctattaaaatcacaaaaaaaggtttcatgaattaggaatactggattcaatatcaagagtacaaaatgctaaaaaaaaaaaaaaaagccaatcattcacagaataaactccatcaggaatagctgtaatatataaaatactaattaaaactgagaataaattaagagtaaaatttaaaaaaaatctataaggtagtaattttgttttattttcttaaatacctatctcttagctgaaagatacacattttacatggtgctctgaagggcaacaaatgaaaactcagttttgtctaattagttaagaaactctgaaagtgacagacactttttaatatcttacattccacttgaaaatttcaaagcacccagtttgtggtattttgtgattttatgttcccaggatccctttccaattagcaggtaaaacttctgagttgtcttgaaattcagtttcacaaagacagtattgaattgtttccaggaacgtgcacaatcatggatggttctaatttgttggttgaactgaaaagtccatgaaaatagagtagctacaacatctagttaaaagtaagatcctagatgaagctccaatatttctattttctcaacttattagtttttgtgatctaagttatctgtccttagcagcttatggcatacttgtttttcactacttacatttattctccattaaaaggtaaatgttatatggaaagcaccctgagcatcttagaggagaaaaaataagcacatttaagtaaatatgtaatgtaaatatcaagaaagacaggaggatttggggtgtccagaatttgaactttatccagaaaacaatatacagatgaaagaaaaaatatataccacaatacaacacataaaggaacaatgacaacaagctgagtaaagtgatgttctttgagttacttttagagttatcttctcctatcagaggggtttctattttatctacattgagcttttgctttagtttttgtgaaatgatataaaaagtagaatgagaacactatgtggtctttataaatattgaaaataaattatcaatagccctctaaatgttatcatcataatctctttattctaagcttactagaatcaattaatattactaacagagaacaaaacttatatttgaatatctcaggaatcatatttgacctttaatatcttgttaaccacattgttccagttattctaatataaatagtctcagtaacaaccaccacaactacaacaaaaacaataatctataaagtaggtactattactttcccattttgacagaggagggaagtgaggcacagagaggtttgtgaaaattttgaaaacaatgcaatagccacattgaaaataagattccttatactaccaaattatagtttatgtacataatttccatatgtatgtcataataattgtaagaaagaagaaatcagcattgttgtataccattttatacaagagaaaactgagcatcagtaagattaaatcgtatatcaaaggtcatcatattaggaagttttagattcaatattagaaccctgctcttctacttataatttcagctttctttcagacatgctctgctgttgctaggggtatttcaatggatattattcaaaaaggtgtgagcgtatcagaatatatatcagagcaaacagagcttatagtttggatgtattagggatgttcaacatatttaactattaattcagcagggccaacaagatatcacaaggaatgccgggtcactcagaatggtctctgacagtctataggctgattaccaactctgtatacagctcaaataaactgaataactggtgcataaagagacacatagaccccagaaagaagcagtcaatggtatctgcatatttgtcaatgttcagacgatatctgggttctgttagggcacattactttcaagaggaacattgcaaaatgaagaggaatatgcatacaagtatgccttgaagagtgtgaatgagacagtgaagagcccagaaaacatttcatttcagacacagctgtagatagttgattaaaaataataaaatttagtataacaaagagatgttaaagaagatactacaacaaaagggcctgcagtcaccctttttgctctgctgttatcagttctgtctctactgcttactatctgtccctaataaagtacttcgacctttctgaacctcagtatttcctatgtaaaatagcaataaagatacctaccatgtgggacttctgaggggattaaaggaagctcgctatttatttcccaaaatgagatagtttttatagtaaaatggggagctaggaataattaagctgagaaaaatggtttgacataagctaagactatacccgacaaactgaaatatgtgctcattctacttaaaggtaacttcaataatcttaaaaagaaatttaggaaactttttttttttttctttttgagacggagtctcgctctgtcgcccaggctggagtgcagtggcgcaatcttggctcactgcaagctccgcctcccgggttcacgccattctccttcctcagcctcctgagtagctgggactacaggcgcccgcaaccatgcccggctaattttttgtatttttagtagagacgaggcttcatggtgtcaaccatgatggtcttgatctcctgacttcatgatccacccgcctcgacctcccaaagtgctgagattacaggcgtgagccaccgtgcctggccacggaaacatttttgacacaagagatgatgagagtaccttgttcgtggaaatgtccaaataaccacatataaaaagtgttaaaaaaaaaaaaaaaaaaaggttaagtaaataaacatcactgaaaatcgccatttctcctgggatctggccacccatacgttcgtcctcaaatgaaatatatgaacttctgttttcaggtaggttggatcagtagttcctaaaatttctaccgtctcccattaactcacagaaatatacattaaaaagcacagaaaagcacaaaaaccaaaaacaaagtctaaagagatatattttgctgaaaaaggaagataactgtcctcattttaagtgactgtgtatcaacaaagaggaacataggccttccacaggtctatcttgcaaagtaaaaactggttcaaaacaaaaacaaaaactggctctcacatctattctcttactcagtcccatcaaaactgctcttatcagtctcaccattggcccccaagctactgcattcaatgactgatgttcagttctcactttacctatcaccatgatttgattgagaggattcctttttcttcttagaagtatttgctaatttggcttcacgtactacttgaacacagttttcctccaacttcagaggtcacctttcctccatctcctttgcaggttcctaatcatgtccctgagctcgcactttggagtgtcctaggcctcaatctgtgttttcctttgtttaggccaaaaacagaatcctccactcccctctctctctcaagcctcacattcaatccatcacaaagtcctgttggctctaacctcaaaacatagccagaaagtgagttatcatggtgctcactactaccacattagacaaagtaccccatcatctctgaggggtatgaatgtttcaaaataggatactaaaggtctttatatttcaccctttgttctctgattatatattatcaacacagcagacagagacaacaggattcagctcaactcgctgacagctgaataaaagctcaagtccttaccatggtctgatcttaattaacttccttaacctttctgaattcttctgctgctaaacatcgtgatttttctgctgcagccacacgcttaccttttccctgatgctacaggcatgctgctgttacacggctgtgcatttatttttccccatgcctaaaaaggccctaaattacttacttggacattttcccccatcaaatgccactttttcagctaggccttttagtgccactctgtctacaagcacatgcataccctctcattttattctgctccttggaacttatcactaacattccacatgctttacatattagtcttgcttcatttccatctttcccactagaatgtaaactatataaggtcaggtatccttatctatatccttctctactctatcccaagtctccatgaaagtggctggtacattataggtacataataaggcgagctctattttagcgtaacgcgtccatatacaatattatggtctctccccttacccacaatgctctcttaaagtgcaaattcataacgaactctaatagctttatataaagtggccataaaaccagtacatggggacaggtgctgcaagctcagtaaaggaaggatggattaaatcaaagtattctagaaactgcatattagttagggagttgggcacatccatcttttcttcagctcaagtcctgatactggtaataaaccaatacctaagtagaaaagaaagagtaccatatacaatccatgagtcaaaacttggtagaatcttacctctctgtttttatttcatggctctgatcttccacctcctctctctatgtgtgtgtatgtacatatatgtacatacacatacatactgtatatatacccctttcccatgttttcaagaccaagggtatcatctgaatactcttcaaccacagtcttcattttcttttatatatttcatcttcaatgaaatttggactaatattaccatattagtccaaattccagtatttcaatattactccaaatacctacagtcagacttcagccttcactactgtacaaaaagttattttgtgaaagtcattaatttggccgggcgcaggggctcacgcctgtaatcccagcactttgggaggccaaggcaggtggatcacaaggtcaggagatggagaccatcctggccaacagttgaaaccccgtctctactaaaaatacaaaaaattagctggacgtggtggcacgtgcctgtagtcccagctactcgggaggctgaggcaggagaatcgcttgaacccgggagacagaagttgcagtgagccaagattgcgccactgcactccagcctgggtgacagagcgaggctccgtctcgggaaaaaaaaaaaaaaaaaaaaaaagaaaagaaagtcattaattttcttcttgttaggaaaaatgcttcttacaacattcagtactgataaaaactacaattacctcctcgaaattgccatgttcataaaaatacctctgcccttgacaatattatctttctcttaaatttcgtcctcatgaagtcatccagcttttctgtatgtgtgtttttctatagagctgtttatcatatatgtgtctacatgcatatacatttttaatcttgaaaggatctatatttcataacatacagtttttaaattatgctattaacatatagaatactaaatactttactcaatatatgcttaatatatgatcacatgtttagaagccactactcggattctaaattatttagtacacataatttcaagtaaagtatacagaagctaaaaaaggcatcagtaaatcaatgtatcagaaatgagtgattattgtgggctcatgaaaattcttagagatcatgaagaattataaatactaaaatgggtaacctaaatgcaaaataaaaggcaactaagttatataatattcaataaaaggaagaaaagtaaaataatttgaagcaaagaatacaacacagggaagttcacaaattcctcaataagttgattaaaacctctttcagacctctgttcctccttctttattagcacctcttaaaagcctcctctttctgtatcttctctaacattatgaaaataagttatggatctctatcagtcctactccgacattagaagtaattaagaatctactcatttaacattctataatgaagttttaccctttgactgaagagtaacttattcactcaaatgtttattcagaagttgttctatccttcatattggtaatagatcctatcttaaatgcaactgcagaactgaaaaaaatcacatatccatatagttaaacatttattggtttgtgtgttaggcatggggacaccaaaaacaaaacacacacacataaaaccaaagccacttcacgttcaagtcctgatttctagaaaccaacaatggaattgaaatgaaaatggctagaaattagtttgtgcaagtaaacaaaaattagatcattgtaggctttaagagggcaatatgaagacatggactttgtcaacactcttcagacaaagaccactggaacatatttgtaggttatcaaagttaacctgatttacacgctgcaacgagagagacagcgcatcacagggaactatggggctgtctctaagagtatgttagaaaaagcttattttaagatgtgggcttgtgttacatgatagggggcatcaaggaagtggggctttgttttgattggatgttgtaaggaagtagggtaattctatgttgagtgtcctaaaatttttatctagatggcaggaggaatgcagagaggctaaagctgtgtttagtaaagaagcataatgtgtcacattaatgaagatgagggatatttggtcattaggcgtggtttggacaatgctattcttttttactgtattaagatatgattacaaagtggtcttgcttttatcttgattcatcacaaccatagcgtgtccctgtatgatgctggcatccctagcaattatttatattcaaccagagaacatcagactggctgcaagtaccaaggcaacatctagcagttccaaagcctaactgaagtgccaagccagctcctggctatcagtagctgattttatctttctcaaatgattataaacacagacataacaagatcatactgaggttttaatatgttcgctttggcagaggtgatgtggaaacttctaaaggaatataacattagtagcagggaagaccagctacaggattgtcatcttaaatagaagtaagccatgatattagctttaatcagggttttggtgatgggaatagagagaactggacattttcaagagctgttaagggagcaggattaattgaacctgtcaaagattggacttgtgaatggtagaagaaaaatctaggtgacccagttcactttcaggtttctggattaggctgtttgcagggtgaaaggaaggagaaagaataaaggaggtctggggaaataatgagatttaagatatcaggcaaacatcaattaaaattgtctattaggcagtcagatatatcaccctgggttttaagaaagagatgagctaaagatacatatgggagaagggttcatttgaaaatagacactatttgaatgggaatgaatgaggatatccagagaagaaacacaaggactctgaagaatatcaatattaaagaaaaactgaattggaacaaatggccaagaatgtgaaagaattaatcaggagaaagcagtatcccataagccaagcgaggaaagaatttcatgagggaaaagaggttaataggttctagttctacagagggattgagtaagataaggcacgttaagtattcacatgcatgtttataggagaggacacgttctaaaagatgaaaacacaaccggtttaaaagctaatgataaagacctgggatgtagatttttgacaatctggatatacagctgaatggaaccaggtggcttaatacatagtcagtgatgctgctgagaacacacacccagagatgagcctcaaccaggtgaaggatagcctcttccactaaggcaggtggaaaaaaaaaaaaaaaaaagatactatgagcacaaatacccacaatttgagaaatattatttcgactaaagtaggagatgaaatcatttactgtgaatgatggggaaagtttaggtaccccacaaaagcttgaaataattgttgagagaaactaagttgaaaatatacttaggatgcacggaaagcttatgaagaactgctggttttgttaaaatatgttgttagtgccgggcgcggtggctcacgcctgtaatcccagcactttgggaggccgaggcgggcggatcacgaggtcaggagatcgagaccatcctggctaacacggtgaaaccccgtctctactaaaaatacaaaaacttagccgggtgtggtggcgggcgcctgtagtcccagctactcaggaggctgaggcaggagaacggcgtgaacccgggaggcagagcttgcagtgagccgagatcgcgccactgcactcccgcctgggacagagcgagactccgtctcaaaaaaataatcttattaaagaaatggagtaatgcctgacaatgacaacatctacatacatacaatcatgacagcaggtagctgaattgaggagatgagagaaacaacagcttttagtgatagcaggagagcccacagggatgctgaaataactaagaatgaaagaacaaattggttgaaaaaatctactaacctagtgccaaagtcttcaatgagaaaatatgataaaatggtagataagagatggccagaagtcattaactgcaaggaaagaggtatttttacatgaagagagcagtatctttggaattgtctctgttaggtgagggagtcagtcattctaaagtagtgggggtacaaaagagggatgagtcatagtgctgttttcgagggtaaaattggtttccacgtatgagtagaataagtatatagaaggcttgtcttgaaaaagtgtttgagcctgccgagtgagagtgtgggaaagcagaggaagtgaagcaaggaaaagaaagtgcaatagagcagagagagaaagatagaagaaaatatagactcgaggtacctatactctgggtagtaaacacagataacagagataggagaaattggaagcattaactggcttgatgatttccagcgggagttggtaaaaagttgattctgaaagagggtaatcaagtgcagatccgaggaagagcccaaagccagatgaccataacgacttgatagggagggtttcaagagaacctcacagaagctccagattttcagacaccttatcaaatccccttgtgatcaaaggaggctattttttttgtttgtttcattaccaatttgcgttaccatgtgctcacggaaaaaattcgagttgttagaatctgttaattcagctaaaaagtctgaactgcagtgatactaaaagaatgtgagaggtaactgctacgtaaagcccaagattgtgtcctagaatattgattctcgagcctttatgtgcataggaatcactcctggaaaatgttcaaaggcaaattttgatttactagttctgagattctatatttctgacaagctcccagataatgtcaatattggtggtccagggacattttgattagaaaggtcccccagaagtcagcttttaaataagtgcattttgttaattatatgaataaaacacatggtgaatatacaaggaaaaaattatgcttaggtttaaaagttgcattttttaaaatatgtgaaattgaactgataatggcctatgatatgctaactggctaaaagcatttgaaaggagtaaatgaagaaatcaagtgaaaaaaaaaagagttggtaatatttagccatttttaatgaaagcctaaaaatggattaataccactcaagttcatgacacgagcctgccatgagtttaaaataacctatataaaccgacaggtgatgtagtaagaaaattaatggatacctaaactgaatatccatcatcgtaattatgtatttctctcaaggatttttaatacatatacattgtatttagcctgagggaaacatcaaggtaaatcatttcatgtcccattttagtaggcaattaagaatgatgttgttatttcagaaaatgagagttcaggttgataaaggggactcacaaggtatcagaaaaccagttataaaacactgtacatttttgagcacttttagtctgtcatgctcccgctattgataaaatgcaaatcgttcataggtaaccacatgataacaggaacttttaaaatttatattcctgaaatactgaaactcaattttcctgcctgatcaaagctgtcttaagataaagaaacagagtatcagacagaaacctgtgagaatcagatcaataatcatttttaattagctaataaaatgctaaaggtgattcatactttcagtggtcaaatatgtaacatgatgtttgaaaattagagtttaatgttctctaattaattttctactactaagagaatttccctcaaaaatcacagcaaacaatttaccttcaaagaagtatacttgaaaaaagacatttagctaattttctacaattatatattatctttcagttttcatatttcccatttcttgaaacaatttagaatagtctattataatgctgacaacagcatgtcttataaagctaataagtaatttaaaatagctttccaatttataagtagttaactctaagaagaactggtgacaaaattgtcttccctttttcaagcagcctaaaaaatagattttttttccagaatatatatatatcttttgttgatctccaaaagttccaaccccaacagcaaacattagcttgtaactgaggtaatgtcgtatttgtaaaaatacaatggattttgaacttcatgatttgaatcctggagagaaaaagcagagctaatatacacatttagatgtgatcttcccatggataaaattacttttcattcataatcactgcttccttagcttgcccattttatttactctgcctgttagaaattattttacaaactgttgccaatcatatacaaagatgcatgttttataattgttgaagttgaaaaattaaagccttgacaatttccctaaagatgaaacactttatattaaattaataaaacttcctatttgtgaaggtcaaaattataccatctcagaagggaataacaacaacaaagcatctgctaccacatgtaaatactgagaaaggctggacaccttttagataaggtaatacacaaatatctgggaaatttaaatatcttataatatatgacagggattgatgactataaagaataactttttgataacagtgagaatatagacatagtcctaagtatggtatctattatattattctattctattttactctattctactctacacaattgtgcaagcttgctaaggcctagccttgaggtaactgaacaatatatgaaaggaatcaacatgaattaatgtcataaaattgttaatttatagttaaataatatgtaagttaaggcaagtttatgaaaggcatccctagtcagtcacagaagaatccagaaagatttctctaggctaaactttgattttgcttgctatctaaaatatatttttaagacatattaaacagcattttatcatatcgcattaatctatcaactagtagaatcacagataacaaagcacggagtttacaagcagcacaaaatgagtacagatataaaaattaatgcataacctacattgactttttcttttaagtctgagaagttgccttccttccgaaagattgcaaattcaggactctgcaacacagcttctgagcgagtaatccagctgtgaagttcagttatatcaacatccaacctaagacagcaaaaaataaaagtcattatttcttgattatctctttcttctatattaaaaaaagcaatttatccacatttatcattcttttctcaatctgagactcctgcctgacacctctattagtattaatagcagcactattttccctgttaggtagactcaaatttggagtcagctttgatctagagtcttatgatcacagaggtcattttattcacctcaatgtaaaaatcacttctacaatatatcctgtaagctattacccagcctctgcttgaatgtttccactatttgaaaaagtactacttcccacgataaccttttctttttggaaagtatttatgagaaaaaaaaaattcctgttggtggtcaccattgaaacacatgcttttctgtagtctccaatcatactgcctctgggtttggccacgtgactttctatcacaaatgggacaatagtaagagtactgcaagtaaggttttgagaagtgcttgcatgtcagagcttgactttttagagcacacattctgagaagacaacaattatataagaagtacaatgaccttgaggtgatcatgttttaaggaaacttgatctgtccatgtgaagaggccacatgaagaagcatggggcaccaggcatgcaaataaagccctctgtgacccatctcaatgccagctgaagacagacaaatgagtgctccagttgatgccacatagagaaaagaaatacccaaagggcactgcctacgttgaagaattaggagaaataataaataggtgctgttttaagccactacattttggtgtgagttgttatgctgccataaatatcagatcacctatcctgttattttcaaacctttttttttttttttttttttttttttggaagagatctttggagccaccagggataaattattcattctaatctggtgatttaggtatagaagagccaaaatatggaatcaacccaagtgtctaatggaatagtattaagcctttaagactatgaatagcctttcatttgcaacaacatgtatgaacccggaggaaattatgttaagtgaaataagccaggtgtagaaagacaaataccacatgatctcacttacaagtggaatctaaaaaaaaaaaaaaaaaaaaatcaaactaaaagaaacagaagacaatgttcatttccaggagctggtgggggtggagagtagttggaaagatattggcaaaaggatacaaaattataaatatttgaaatccgctctttaaatttatcagtagatacctgatcatcagcctaccctatgcttaattacttcaacggatattctatggcttgttgttatcttagtttccttaaattgggtacttaaagggaacatatcagcagtgtgtaaaataaacagggaagaataattatctttctggtttataatactttcattgatatagcccatgatttcaataaatattttcacttcaatattagactttcaactcacattgcaattcaattgacttaaaacttctaggaattttttcacataaactatcattaaaccagttatatcacaacctaattactatcacaaacatatgacctgatctattgaactccagttttgggactttgaatcatataaaccagttagaatttctcacatttgttgcaggctattgtttaaaaattaaacagatacagaaattaatggaacacaaagcccttagaaaaacatattcgcattttatattctcacaaaattctttggttaggtatcaccaattccagctgcccataggatgagatggagcttcagagaaattaagttaattgacctcaataccatgggtcagaaacttgacggttcatagcatacagattgagttgttatttatcgaggctatccaacttgaaattaagagactagggatcctgattcctctaaatcccatgtcactgaatgtcagtaagttatctgtgtatgcattacaaatgtttatggatttttattgtgtcatatatgatttttatctttcctacattttttatccacaagtttgactatcaggttcctgtttcttcattcataatgttgattaaaatatacagtacaattatatgctgtaaaaatctttcacactctcttcagcgatgttaactccttaaatactctcctactatggttatttgattacctacccaaaccagtgaattatatttcaatcatcttttatgcatatttatcatcataatgtcttaaaacatttttatttttgctttggcccaacataaaatttcctgtgtctctctatctgcaagcatctatttgccagtatattggacagagaaggagtgctggaatgttaatactttaggggtgtcccttaaccagtgagagcttggaattggtgaatttcccagctcccttgcccctcagttggacaatcctgaagtatgatacacagtgtctcaaggggttccctgcatgattgagccccagttccttccagcagtaacctgatccctatatttgtgccatactttattggctgctttatttttcttatttcacttccctactttgtttcctgggatcactttccaaataaactgcttgcacctaaatccttctcttcagatctactcttggggcaacccaaactaaggcaataatcaacagcctcaaatgaacctagcatcctgccatacttttttttttttttttttttcccaagttgggctctaagtctctacaggaactattaaaaccttttatcaaagctctggcccatcctctttctgcagctctctcagatgatcttgttccctaccttacagaaacaagtgcaattatcagagtagaacttctttcacttcctatttccaaacaccatcagacccgcatatgtagccaccgttctcattcccttcttttacatttgagtttcccttcttttaattaaagtcattcccactacctacattttgaactttattctcttacttttgctcaagcatctgagtccatccaatttctagtatttgtttattttgagacggagtctcactctgtcaccaggctggagtgcagtggtgcaatctggtctcaccacaacctctgcctcccgggttcaaggaattcccctgcctcagcctcccaagtagctaggactacagttaacactgttgaccatactatccgtttgtaatttttcttcctttggcttcatgatgccactctattctaatttgccttctatttctatgaccattggtaattttttctttgcaggtccatcctcctccaccctatcattatgtactagatgtcaagacctagttcattaccaatcatcttctactctactatctctcaccagaaaacacatcagtcatcatgccttgaattgcaatctatttatcaatgattctgatatgtatatctctaattcaggcacttgttctgaattccacagctatataaccatctgcctattggatgtctccacttgcatgctgcaaaatctccttaaacattatatgccaaggtttaaagtttgatcttctccctcaaactagtactctatcagtattccccagatcagtaattagcatcaccatccctcatatttgttatcttcatctccgctatggactgaattttgtgccccacaaaagttcgtatgttgaagcctaattcccaatgtgatgatattaaaagatggggcatttgggaggtaattaggtcaagagggtagagccctcatgaaatgagtccccttaaaatgatctgaagagatcagtgttcttttccaccgtgtgagggcacagtgagagagcaccaagtatgaaccaggaagcctgcccttaaaagacactaaatctgctagttacttgatattaaacttcccaaactccagaaatgggagacataaatttctgtggtttataagctacccagtttatggtattttgttacagcaaaccaactaaaaccctctctcttccttcccatgtttaatgtattgcaaagtctaatctgtcacacatacattctctgtctcctgaatatgtatgcttcttcctgtctccatagccagaacccaaatctgtgttgccattaaatgtgaccaaaaataccgcaatagcttttcacttggcctctgggcagtatttatggaactctctcttttatgtactactggaaaaattatcatttctatcttttttaattgacgcataatagatgtacttagattgggggtacatgtgataatttaacatatccgtataatttgtaaagatcgcatcagtgtacttgggatatccataatcttaaatatttgtctatgctagatacattcaaattattctcttctagctactttgaaatatacggtagtaaaaacatatctgattatgttaccttcattcgtaaaaccactcaaagactttctcatttttcttagaataaagaacaaaatttcaacatgatcctttataatctggccttcatagacctcttaactgtatattctactttgtcttttattcaagtacttgtagaaacaaatttcgcttcatattttctaaagtaattcagagctattctttattcttgttcctcctccaatggaataaaatccttcactgactcttccataaatattttgaaaactgggttgttaatataatgcatttgggccactttggtgaaatttatttgtctgactcaattatacatcaaataccctctgactcataaatatgagataggaatatccaccagtcactttcaaattcacgctttaaacttaatctctctagtctcaccctcatttgatttagactatctctaagaaagattgctcacttctacttagaggtccctgaaactcaaacgtgcctcaaggtactaggctggcatgacagctgaaagaaatctgctgaagcctatgttggagaaagatttctactaggcgttgaattgacattgctcttgtttgcacactgtaggggctcagaaaacgataccccaaagtatggcactttggcatgctgaaactttgaactaaagaacactggaaggcctcaaaagcagcctcaaaaccaaggtccctctgaccttctcctcccctcctgtctttaactccacattcttccctgaagtgagtcatagtaaccagaattcttcttcttcaaggtaggtcatagaaaccaaaaaccctctcctccaaagccaaccataaaagccagaattataactctgtattttgcccacctttctctctattagctagccataaaaaattctctgacatacttttgtttgatagtagatcataagaccctcattcaagtggggtcctaccccatgtgtaggaggaaggaattctacacagacaggcctggctggttgtccctagtctattactatcagatcattccctttttgtccaatcacattcctacatggctgtctactctttatcaactctaagcataaaaacagttttcctttgggtcattgggtcttcatttttgaaggctcccatgtcacctaaaacttttattagataaatatctcatgcttttctcttgttaacctatcttttgttataggaatgtctgctatgacctgtataaggaggaaggaaagggatcacagcctttctgctcctataacatgcatgttgatgtaactgttataccaccacctccaattcactgcagaaaaaagaaacaaagttgtttgtttttagtttgaaagtaaataattttcattccaaaagaaatcttttttttttttttttttgagacggagtcttgctctgtcacccagcctggagtgcagtggcgcgatctcggctcactgcaagctccgcctcccaggttcacgccattctcctgcctcagcctcccgagtagctgggaccacaggcgcccgccaccacgcccggctaattttttttgtatttttagtagagatgtggtttcaccgtgttagccaggatggtctcgatctcctgacctctagatccgcccgcctcggcctcccaaagtgctgggattacaggcgtgagccaccgcgcccggccccagaagaaatcttgtaacacttttagaggtgtattttcctgaaaaaggcaaaattgtatgtttccttttaaaacggtcaaatgtctcctttttttccccttcataaagcatatactaagtgcttactatgtgccagacatgctattaactccataaagaacagagacgagaatgcattagtccacattatcaagtaatttggtttagtgaagcatttgtttgacaagataaaaatggtttagacacagaactggggctcagctcacactggtctttttaagaggataatcaaaaaacaccttctctgtaaattaggattaaatcagcttctagcctagaggctctgccaagtatattggttatctccacacaaagaaggctttgtggagtcaacaccatggtaactgtctgtttgcttctctgtctgtgaagattttaagggaggcctggacaccagttggcacgtagttctgataattcaaatcaattcaaacaacaggatgtgaaattctacagaaaggtctttcctcattcaattttttgtctgactttataaatttggaaaggggtcacatacagtgcgtgaacttcccttttatacaaagatcgtatggagagtgattacgctcgttttttgatgtacagatttttaaaaaggcaatttcaaattttactagggcagtggtgaggagagcgttttgtctaaggaaaataacctattcataagcacagaggttaatgttatacttcttttctaaaatggaacaaagaaacatattaatgagtttggactcttctcacctgttggagttcttccctttcatttctatcattattgtgatatcttgatttcatgggaaacaggtggacactgaacccaattcttacacaattcaagctctgagctattcctaacctaatcttaatatttattttatgttgcttccatttggacttcttccttcaaacatctctgatttccttgctaaaactctttttgtccacacataatgtgcagtcagcctacactctaatacttaacatgtaccaccatctcttagagttctgggagttaactgtcagctactagcattgttttctctccaatattctgccagtggatagcctcatctctttatgccagcaatgaggatggaagggtgaagaggaagcagaggcagggtttcaaggcctcccatgtactctccctgagtgccaatggcctacatccaacgcttagttttaggttcagtgacattttcaatgcacaatgaactcagtctccttcccggatcctactcagaccctggcttccaagaagcaattgcacgtttattttattccttatcaatttagcaactatcgcttcatcactttttgtggtttgtcgtgtagttttcatgtatttcactgctactagatattcctcagatatctttgctgagatgcatggcaaatgaacagacacctctgatttaaatgtcttcatgctttaaattgggtgctatctactcttcccagtgctttgcagatggcattttctatcatactttgcactaagtgagcctgggtatttaattacgaacgaaatatatcattcagatgcaactcagttaccttctttaaaaccctcaaggaaaacactgaagacttattttcaatgccatattcaacgttggattctgtacatgtatttttgcttcttcataaaattactcgtttctaataattcttttttccccactttaacaactcacataaaaccattgctaatgaacttatgtatcataagttgctcataatgtgtccctacacctttggaatcagtccactaatatattccttagtgcttaacttactttcctcatatacttaactctgtacttaacgtacttccgaatgttatcagactctatcccttaaatgcagtctaactttacctagcttaaaatctcctttagctaataaaaaaataacttctcattctctgttcacaaaatgattatttctataattattgatgaatattctgtcctctattcttcaagtatatcttaaaacctcaatttgttattatttatggttagcagtgaagcgacaatttttttctcctttacaaatatactcatcagaaacccctgaaattaaaacttgtaaagtcccatcatacagggcaagtaagtctttgatttttttttttcttggcaaaagtgtattactacaccaagacaatttttcaaaaagaccttccattttttggaagtttcaaaatatcaaaagcctggggcatatataccaaatattcagagagtgacaatttttctcagtattatattgtacaaacagactcagcctcatccagttgaatttcccataaaaatgatgtaaattaggttaattacatcccatatggtaaatactgagagatacctgtgtatataaatgtttaaaataaattcaaaggcaaaaacacatacaaacatctcaaagaactagagaaatgtttgccatttaagaagttgtcaattttgaattgtcaatagtaaaacattacatgaattagtgctatataactgtgctaattatgtcagaagagcctcctgatgggcactgtgttctgttaattttctttacagtgactgccacataacctattaaactaagatgacacatttacataaattttaattcagtcactttcaatatacaagttgcaactcatcattcccaaatgtgtaaactttgagagtggaagtcctccaagctcccagacttaactaatttgattagtgaactaggtttatgaatggccattttacatatttaaacatcttagcatgtagaatttcataaaaacttataagcctcatccttagaaacctgaaaggaaaatgctgatgcctgtgaaatacgttaaccattgcagggtcccagggctctaggcctagaccagataatttatgaaaccaattcttaatgaacattttaattagctaggaagcaagttttaacattaataggaacaaaactataattattctttgttggtattaaagaagaaataattttggaggtaagattttccaactttgctgtatttttaaaaatcacctttcttcttcagagttttccgaagtgagaagacattttaattccatattactatacaggcactttcctgaccctaaatccccaaccatttgaagatgacctactattcatcttccaaggctcagttcaagatgcacatcatctgtgaaggttttcttgatcaacctctctctactcttcccctttcaactttccttctgggaaaacttgtccctctctgcttgtttccacatggcatttgctttaaaaaaaaatcgagtaatagaatacaaattcaatttgcatcaaatagatcttataaaaatatcaaatgaaattcagtataaatcctattagttctaaaaatatttttaggactttgagatgcattgactacatggcaattattatatttttggaattacagaatattattaaaggggaaatcctatttaaccaaaagaaaacaagctaatatttagataaatagttccctctccaaatcaagatagtttgtatacacacacacaacacatacacgtttgtatagtgtaagtgtgtctccctctgtggaaggggggaagatagggccacatgattgtcttgtattttgtaatatgtgtgatacgtgtgtgtttgtgtgtatgtttaagttgctttaaatgtaaagtaaatgtgcatttaaaaatatactgagctgagggccaggcgtggcggctcatgcctgtaattccagcactttgagaggccgaggcgggcagttcacttgaggtcaggagttcaggaccaacctggccaccatgacgaaaccccgtctctactaaaaatacaaaaattagccagctgtggtggtgggcacctgtaatcccagctactcgggaggctgaggcaggagaattgcttgaaccagggaggcagaagttgcagtgagccaagattgtgccactacattccagcctgggcaacagaacgagactcagtctcaaaaaagaaaaaaaaataacatagctatatatgtgtgtgtaaatcaggcaccacaggttttaatccctaatttttatctttctggtattttcttgggtaaattaatttcttcgatcttcagcgacttcttgctttaaattgtaaaaatttaaaagctgttatcaaactggtcctgaagtaaaaacatactgtaaaccaaaaataaaaggctaactccccctccaaagggacttcctcctcagccagggctcttaaaatttaacctgaaagactggttcaggccaagaagggaagtgggggtcagacatgcctcattatacctctctgacacttacatcaacacagactttaagtctgataagaagcactctacagcctcttctctctgaagcctgctagctaaaagcttcatctacatgataaaactttggtatccacaatgtcttatctcaacccaaacattcctttctattgatcccaggtctttagacaaactcaaccaattgtcaaccagaaaatgtttaaatttacctacagcctggaagcccccacccccacccagttgtcctgcctttctggaccaaaccaatgtatttcttttttttttttttttttttaattttatttttttcagacggagtctcgctctgttgcccaagctggagtgcagtgacacaatcttggctcactgcaacctccgcctcccaggttcacaccattctcctgcctcagcctcccgagtagctgggactacaggcgcctgccgccacgtctggctaattttttttccctatttttcatagagacggggtttcactgtttcagccaggatggtctcgatctcctgaccttgtgatccgcccgactcagcctcccaaagtgctgggattacaggtgtgagccaccgcgccaggtcaaaccaatgtatttcttaaatgtacttgattgatgtctcatgcctccctaaaatgtgtaaaaccaagctgcaccccaaccaccttgggcacatgtcgtcaggacttcctgaggctgtgtcacaggcgcgcgaattccaccttggcaaaaatcaactttttttttttttttttttttttttttttttttttttgagacaaagtctcattctatcacccaggctggagtgcagtggcacaatctcactgcaacccccgcctcctggggacaagcaattctcgtgcctcagcctcccgagtacctaggattaggcaaaatcaactttctaaattaactgagacctgtctcagattttctgggtctacaatacaaatgctttttaaaaattacttgtaaatatgtttacttacctctctaattaaagaggttttgacccaagatacaaaaactgagatcagctttgcttatattgtggctttcatattccaattacattagtctattcatctagcaatcaaattaaataaaatctaaagatgttataattcccagttataataaaaagcctataaactcttcagtggtttacacagcacctggaacaatgtgacagatgacagaggactctgtcttcagttagtggaaactgctatattaacattcctatcaaaaatctatttttccttatatttgcatggtctcaaatgtatttctagttttatatgtgtaattttaagcacatcactcataaaataatatgtttcagtacagtaaaatttaatgatttcagattgcactgaaaggcatctttaaaagatactaaaaaatcaatttctgtggcgtttaccttgtcctaaaatatgcctatttaacatgtgcctcaaaagctgaattctagtccaagcacaaaatattgtccttaaaattgtacatcttctttattatcaattatggcataccgaattatatacttagtatgtttaaaaattctgctttttaaaatacatgcccttgcatacaaattgaatgatttaatgttttaagctattaatgccaaaaatgtctgagttatttggtattgatattcatcttggcacccatagaatcgttgattgcagtgaagagaataaaactgctgtaaaatattgcttctctgcacaaagtaaaacttacctaaaatattttgacgtctggtaggtagaaatgatgttaaaataatcttcctaccttaatttggtattaaatcttaatcatttcaaaattcattggtaatatttatttctaaagtgtgacatgattgaacagatgtcacatttataagttttgtttaaatatctttgagagaaacaaccttaaaaattaaaaggtaagaaacccccacaaattctaaaatgtcagatactgctacattagaggaattagttataaagccaaggagtgtgaaaacacgtgggcaaaaactgcatgacccagaggatgggaaataaaatgctgctaagccacagatgcctaaagcctatttttcattttcaataaattgaaagtccctttgaaacacacttctgtgcaagaaaatcaccttaacacaggttaatagaaatattctcttaaatgatagatgaaatcctgtcagagtaataaatctatgatcatacaatataatatactcaagttgaaaatcctgagtcatatattttaaaatcaaatgtaaagtttatttaaaatgatgaaacccaaaagctgcctatgtccttatgataaataaatgtgggtcactagagggcgcacattccctttcagagcttgtcttcaatttggcttctttcgttttcttatctgcataacgaaaatatggtgacaaatgaaattttcatggaagttttacttacacagaaatataaaatgtccaaagatatagataaaatagtgtacaaataatatgtaagtaagacactctcagatgcactgttaaaatgccttcagccattttgaggtacacacaaaagtaccttgaagccataatacatagaatcccttgagaaaatatgtccacagtttggagagtcatgcttagttcaaataatttagtaaaattttctggattatgtagcaagtagttttccttcccaagttcattgattttaactaatttttgaatgtttagttaaatatgtggacactcgtactctaaaaatctgcttaaaattatactcctaaatcacctaaagttttttaaaatgccaaactttcattcaaatttaaagaacagaaaagagacatatatatcattttaagcatcttaatcaggtcacaggctttcaaaaagaaaacttaatcgctcaagaaaccttgtatgttatctgtaatagcttttatttttgcagattgatcatgaatagaaaagttgaagatcttcatttagtttcaatacacagtgaagcactgagtcaagactcaagaacaggtctgtctgaatccaaagatttctacaacactacatttttcttttgttccaaataaacgagaaacccatcttaaaaaaaaaataaggataagtcaatatagaattactgttcattgctacacagtacagtaatttagtggttttgactacgctatcttggattatatgagaatttgattgaagtctctaatatcaggatattaattctgaaatttttcattaaaatatgatccttagttgtatactttgtaccctaatggcaatataaaataatttatttcccaatttattattaccttggaatttcccttaatttcctaaaatcctcaactttctaatctgatgatacaatttctcacatcagagaaaatattaagcatagatgaaaaaagttactacttattatataatgtggttaagaccatggtgagctccaaaagtcttgcacttggaaaaaaaagttcaattatatggaaattccacttatttttgatgctgaaaaagacatctaaattttaaagaaatcttttcagtgaaaaaggtctctgtatttaaagataatcaagtgttgccatgggacactagagtcaatgatacttcagaatgtagaacagacataatctagaataagtgcagcttccatagactttggcaaattcttaaggagtcccagtcaagcattttatttcagctaaataatttgatgaaatcacctttaacttattacaacatagcaaggcgaggaatttccgaaggcaacaccctaagctaggctgtctgggttcaaatcctagctgcgatgcttcctgtaaactatgtgaccatgagcaagtcacttgaaatttctatgacacattgttatcattggcaaagagtgacaataataaaacttacttcgtaatgctattttaagtgtgaaatacattaatatgtagcaaatacttggtagaagccatatacatattagctattgttattaatatcttccatgatccttttttaactggctttaagccctatgccatttctcactttctcacgtgtgagagtagtcatatttgttttagtgtcttcttaatgactgataaagtaaaagccacaattggaataacaagaataaaaactgcaaacacagctataacaaagacaatgaaacatataaacaaaaatcaacagcaaaatagtctcattttacccattagtgccggaatccccaaagtatgttctatgggacaaatatggtctgccatctaatttggtaaataaaattttactggaactcagtcatgctcattcatttatacattgtttatggctgctttctagctatagcagcagagttgagtagttttaaaataaattttatgatacacaaaacctaaaatatttactctctggccctttagagaaaacttttctttcccccttcccagtctatgaaaccaaggtaagatggcctctctctcccaactctcaagtgagatcaaaatgatatggttcacagtagccatatcatatttctctctctcaaaaatatgcaatggctccccatgaccagaaggtttaagtctacatgccttaatcttttattgaatacctttagttattatgaactcaacctaccttttcaacctcattccttacttctaaacttcctttacttcatacttctgctggaggcaaacaagaatacttaatcccatgtaagttttgttcgcatacaggctttcccctgcaatgaattgtcactttcctcatcttgagcccaatgcttccctactctttaattatccagtcagatgctaattttcccataagtcttccatgcctctcaagcaggaagtgaacttttcttccttaaaacttttctaacattttattagtacttcttcatgacagtttatgctgggtgcaagcttcctgagggaaagcttagatttacagttaaagtaactggagtgttttacataccatagcaatccattagatattagttgagtgaataggaaaattagcatgaaaactaatgttgctgtctcttctttcttgaaatgatgtggactcataatgactacagaagtgttcaaagaaacccaccatgcattggatgatgacttggaccctgtgggaggcaatttaaactttaaactctctcagtgtgaaaggtccttgagtttaagagaagtcaacatgcttgtgggtctttcaagtttaaataacttccaacccgggttccaaaaggatctagtgcaatgtggaaagccatttcaatctgacgtgtacttaatgccccactgccagcatcatgacctgtttcaatccatctactgtgttagtaagcatcactatgaactttagtcaaaacagaagtaatactcattgcttaacaaagccggtttttagtcagctagcacttacataacaaaataccatagactgggtggcttaaccaacagccacttatttctcgcagttctataggctacaattccaaaattaaggtaccagcaggatcagttcctggtgacagccttcttcctggcttgtagacagcctctggtatagtttggatattcgtcccttcccaaatcttatgctgaattgtaaactccagtgctggaaatggggcctggtggcaggtgtttggatcatgggagcggatccctcacggcttagtgctgtctttgcgatagtgagttctcctgagagaactcacttacaaatgtgtgccacctccccctgcactgtctcactctccttgtcccattcttccatgtgatgtgactgtttcccctttgccttccatcatgattgaaagcttcctgagacctccccagaagcagacgccaccatgcttcctctacagcttgcagaaccgtgagccagttaaatcaattttcatgtaagtcactcagttgcaggtatttctttataacagtgcaagaacagcctaagacaacctccttcttgctgtgtcctcccaaggcagggagaaagagccagcaagctctttgttgtgtcttcttataagggccctaatctcctcagaagagccctatcttcatgacctcatctaaatcaaattatcttccaaagtctccatttccaaattccatcacattggagattagagcttcaatataagaatttagggaggacacaattcaggccatcccagcctggcatcatttttatatctctgtggtagcataatatgtgttcatttgtaaagagacaggtttctgaccagggaagactttactaagaatactctcagaagatgtcagaataagaataatatataaatgtggtcatgggaagataccatccctgaattaataattggaaactcaactttctcctggggaaaggagacattgttttttaaatgtaaacgttcttcaagacaaacacatgtaatataatttccacagtgtgagggcaaacagggaaggccatatacattccatttcaggggtgacgaaatagattcttggggagattaagtggcttaagtcacatagtttatgagcagaagatgcacggccagaacccatctgtgcagtaatatgcccatctgctctcagatctattccccacatttcttctgtactttctgtattagagggatatacatttcccaacaccacttgccctcctaattgttcatttggaggcaatggcagaatattggaaggtgggaggaagagaaaagccaaggtcttttttcttctccaactaccttgggtggcatttctagagcagatgtatctctgctgtggcttctgttttctctggatagctagctccctcttcaacaatccaattttctgcctggcagtcctaactttagtttaatctctgttagaaagccccagcttctgagctctggtaatatcactttttctgtattgtttctccagctctagggatattagcagcttccttacgttactagtgctttgagttgcctctccatcccctgcgctgcgtctcagttttctactacctgcttagccaattccttatattacgtttcctctctttaaatcacagtgattttgtttttctgacaagactcgcacaaaacctggaaaatccctcatcaacatccaataaatatttattcaatacctactatgagctgacttctgctttatgcattataggtgtacagatgacaagaaatgatttcttccctcaaggcgtttactggagatacaggcatgcaaaaataaagtcattaccatacaatttggcaagtgttttaatagaagtgttaaaaaggctgagaagtggcctggcactgtggctcatgcctctaatcccagtactttgggaggccttagcagtcggatcatgaggtcaacagatcaagcccatcctagccaacacggtgaaaccccatctctactaaaaatacaaaaattagctgggcatggtggcccttgcctgtagtgccagctacttgggaggctgaggcaggacaatcgcttgaacccacggggcagaggatgcagtaagctgagatcgcgccactgcactccagactggcaacagagtgagactccgtctccaaaaaaaaaaaaaaaaaaaaaaaacacacaaatggctgagaactgcctctgcaaggttagataaccagaaagacaaggtggttagtagcacggtggcaggtaacatgggaatgggaaaaagaaaggtatctaaagagaatcttaggcagagaaaacagtaggtacaaagaaacagaagcttaagaaagcacagagcatttggagatcaaagagtggttaatttaagctaaagcatagggcagtgcggaacaaagttcagactttagcagacagtgaactgtttgctattagtctgtaagaagaaaagagttttcaccagagtataaatcaactgagtcactgaacaaacgatttgatcttattttgcttttaattgccgaactttcttgacaaaggaaggagtacattgatttatattctggctcaagcttcttatctcaattgtggactggtactaaaaagtttgcagattatttggagtagcactggtattttttttaaaaaaggagcagaggagaagggagtgaagctggagaggtaggcagctaaagatcacaaaagaatttctacgccatgcatttcaagatttatgggcaggggaataatctaattaaaactgcattttaagatatccctcgggaggctgtaaaaagcatggataagagaggtgagatcagaggcagagaaatcagttaaaaatttcatacagaaaaatttcagttttaactagagtgaaggcagcaaggatgtagaaaaaaataacaaactaaagagaatttaacaggtacatttggagggatttagtgatgtggcagatatcaagaccactgtgaatggctgcacaggttgctcactgcacaagttcaggatgtaccattcttagagactatgatgtgaatgaccctctctagagttatacgatctaaactccaaaactatattttagattccagtcagaaatccaggaatacatagcctataagcatttgaattatacagggatgaacatcaggagagagggagaggtagaaatatcaatttgtgaatcaaaaatataggtgatgataaagattataaatgatatttccccaaaaaataaagcatcataagaagaaaataaaatcacaatttgagtcttatgtagactgacattaaagggcaggaatagaagacagggaagatatactctgaaagaaaacaggagagaacaatgtcccagaaactgcaggagagaaaaatttcaagaagggactaatcatttctgtcaagcacaagacaaaggtcaaaaagggaaaagaactgaagagtgacctttggagctggcaattaaggagctctctggcgaccttgctgagagcagtttcagtgctcgatgtagagtatgagagggtaaaggaaagaatcaggagtccgtaagggaatacagatagttcaggtcttctgattaaaaactgacttttatttgcactcaactatgcttctccttttagatgaataagtatgagtaccattttcttcactcaaaaaacgaacaaaattatatgtaacagctctgggaatgtgatcctgtcttctttcgtgttgatattcttttacgccttgcattctggaagaatacattttcacatagctactgtagccagacatccaaagatatagtatctcataggaccagttctcaatatagtgcatttctattcacagcttgaattgagcatctactacacagaagacatcacacaggtaacgaacaagaaatggatcctggcccagggaagctttaattctagtggatgaaacaagcatatggatagatcatttcatcataaagcagtaaggtgtcacaagatgcaacagtagcatcccttaacctgcccaggaatagatggcccctgtcaggcctctgagcccaagctaagccatcctttcccctatgacctgcacctttacgtccagatggcctgaagcaactgaagaatcacaaaagaagtgaaaatgcccggttgctgccttaactgatgacattccaccattgtgatttgtttttgccccaccttaaccgagcgattaaccttgtgaaattccttctcctggctcaaaacctcccccactgagcaccttgtgacccccgcccctgcccacaagagaaaaatcccctttgactgtaattttccactacccacccaaatcctataaaacggccccacccctatctcccttccgtgactctcttttcagactcagcctgcctgcacccaggtgaaatagacagccttgttgctcacacaaagcctgtttggtggtctcttcacacggacatacgtgaaagcccctttatgggggctgtcataaggaaagagaatcaggggtcagactgtaaatgacaagacactccagtgaactgatttccaaagtgtgggccctaaatcagtagcagcagaatcacgtgggaccttgttagaaattaaaattcttgggcaccactccacgcctattagaattagaaactctggtgactccgacgcatgctgaagcatgagaaccactgttgtcatgccagtgcgagggttctcaaattttatggtgtataagtatcaccgagagtgcttgtaaaatatttttgggcccaccagcagtgtttctgattcagcaggtttgggaagggccctccaaatctgcatttcaaagaaggtcccaggtgatgatactgtttcatgcactgcagtttgaatattactgttctaagtattctctgatcccatagcattctctagaattcacattactatattcttcaaaacactgctattgatttattcttgatgcataagacaacataatctcaagaacatttaatagatggttatctttttgaggatgtgaagatggtatgcaagatttctatttcttttttttttttttttaacaaaaaatagtgtctaaagcgaaatttgaatttatgaccaaggtcattttcctttaatacataaaaagtaacatgacattgcaactataacactagaatggatttaggagagtcagcaccagtccttattttgcaactgaaagcaagttatttaacctttctggacctcaattaacctgtaaacatgcataagtctagtctccttaggaaaaaaagaagcaaatcatctaaaatgttttgtttctatgggctgtgccaataggcaaaagtgtcattactgagtttaacatcccagatattttaggatcaatttatcatatagaacattaaaaaaaaaaagttcacggacacattaattatctaattaggtccttcaaataacttggtatattttgccatacaactttcagattttagtttagaaactgaagttataatcaatatctaaaacaaaaatgttttaggcatgagtctcacaaaactgcagagcggtcttatctgttatctattttctttccagagatgtgacacaatttaacttcatctggacagcagccataaaaagaaaatcaaacaaacaaaaaacagaaacaaactgaaaagtagaatatataataataattcaggtatgtagatcagtcaatttatcctcctatgtagttaggatgcaggaaatagccgagaaagcaagcttacattctgtctgcttaccctggagggaaaaaacagaccaggtgaactgaggcatttcaaaatgcctctacattatccttgaggacaaagatattcatttatgaacgctttacttgggggaaattatctttattaagatggcattcacttaaaaacaatttgccattcattctgcctggttgctacaaaagtataaattaaagctttttttaaaaatcccttaaaataactgctacatgattaggaagtaatctcctggataaataccaattaactagataatagatctagttttaccctaggctgagttccttactctgataattacctacgtgtacaataatatcactgaattgcaggaataatttgctattagaaataattatcttgtgacccaagatcatcagacacttttgcaaatctcagtgtaaagagaaaaatttatgcaataaatacaacatatgtagaaactgtataattatttaggaatcgactaaatgtaccttagatagttaagaaactatgtggtagaaagctgaattttaaatcccttaattgttttgggtaaataaggataccctaatgggtaaaattggaattattaaagatcatcaggatggtcacgtttattattaagaacaattccaggaagagctaggtagaatttttaaatgatattgaaatgtcaaattttagttactgcaattatttgaattatataccattcactctctcaacaaacatttattggttacttattgtatccacggtatttgctacaatggaatctaagtaaaacataaagaagtgtaataataggcttcctttgttttgacgggcaatgagaaattttatgtgagtggcatgaaggcatacaacaaaacgaatgtaatgtaatttactggctgaagtggaataatgattattgggaaggtagacataaaattagtggagaatgagaataatactgaatgccataggaagcacttgggttttattttggaggtatctggatttatgggaattcgcatgtctggagagacatcaaaaagcatcattttagatatattcattttagtaaatcaattagaaaggagggcagttctctccacagtgaggtatatggctcaggttatggacttggcaattcgaatgaacatgaaatgacggaaatgatggcacttgcccaataatacaatctaattataataaataaggaaaagaaagtagaagaaaaattcacagaactagagatgtcaggtggtaaattctgttttgaagaggaaaacaggaaggtaattttacatttcttaggtttgagataatgtttattatggaatttttccctgtcgataatagatgactaccatctccatcactacctccaccaccatcatcatcatctctactatcgttacctctcccaccatcacttctactcctcctacccaccacaatcttcctccatcttcatcatctctatggtctccaccaccaaataagaatcgaaccactgcatttattgaatgtttaccaccttaaaggcaatgtattaaatgcttatttaatcctcatgacagttgttttataaagtgagaatactggaatctgaggcacagataacaagtaatttgcctgcgctcataagctagtaattaaaacaggcaggtttcacaaataccacaggttcttacctataagtgagagataaacactgagtacacatggacacaaagaagggaataatagacactggggcctatttgagagtggaaggtgggaggcaggtgaggatgggaaaactacctatcagatattatgctgattacctgagagacaaaattatctgtacaccaaacagccacaacacgcaatttacccatgtaacaaacctacacgttaaccccttgaacctaaactaaaagttgggaaaaaaaaaaagggcagcattcaaacctcagtaattctgattccaaaagcaatgattttttccatatttgctacttctctagacacacaggcaatgaattataactaaaatatgtgtgcaatgtataagtaggtatggttaattggaaggaacaaatgtttgcatttgatgaacattgaggcagttgctggatgcacaagcggaaatagctttagagatataaagctttaatttgagggagagtgtcacatctggagctacatgatttgggagtcagtcacttagagccaggctcgaatcaatgagaggagataatccagataaagaagtcaaaaggccgggcatggtggctcatgcctgtaatcccagcactttgggaggctgaagtgggtggatcacgaggtcaggagctcaagaccagcctggccaagatggtgaaaccctgtctctactaaaaaatacaaaaaaaattagccggatgtggtggagggtgcctgtaattccagctactcgggaggttgaggcagagaattgcttgaaaccaggaggcggaggttgcagtaagctgagatcccgccactgcactccagcctgggtgacagagcaagacactgtctcaaaataaaagaagtcagaaaggcaaagagatggatctgtgtgatactcccataggaataaggcagaaggaataaaacaagtcaggtaaagagtcgtgggtgacaactggtagtgtgtcacagaagctggaagaggacatcatttaaataaaacactattcaacagatggtcaagacctcaatattcagtgaaatattagtgggcttcagatgatacaaaaacggggcactagctaatataaagcttatggttatatttgcatgatgcctctttaatcattacaatactttaacaagattccaccctgtagacaattatcaattaatgaatttgttcctaaatgtttgcctttttgctatcttcgttcagtctaaatttatcaatcaagtgtcgtatatagcgtgttcagataattttgccgtccaaatcaggacacacttgagagtgaaagttgatgctatatataattatgctgggacaacaggtgtaactgggatggcttcaggtaaatcaataggattaccttagtcatatatctatgaaaaagacattttactatacagcccaggttttgtagctacctcagttcaaatcctgtctgaggtacactgtagctgtgtataattttataaagtaattatagccatacctattttgggaggttactgggaaaaatacatgcgatgccaataaagcactgaatctactactgagcacataataaatcctcaatttatgttagcttttatttgaagaatctttctgtatgtgcccaatgggacttctcatttaggcacatacaaaaattgccgaaaacttatgatacaaacaaattttggagagaaggtatttcaccactagccactctttcctgaaaacaaaaagaagtcagaacacactttttttttttttccaacacaatccattctccaaacaggagccaataataagcttttgaagacagagattgacatgaatcagcttgctctgttaatttctgtattaggcaagtcctgaagacattaaaagtgttaggcaactaggtgtccctattactctgtttggagaactgttggagggttgttggaatgttgcaaagtatccataaatctgtatgtccactaagcgttgtctataaacacatgtttaatgtgacaacaaacaagttaatgtacatcttactaggaataataaaagaaattcatcaaaagcttcacggatttgtgccattatgcttttcactccatcaatttttgttagattttctattaccatcgtgagtagagtgcttggaagttcctgaaagttgttgccacaaaaagaatgctaatattcatagagtttgagagccatttgactggagcaagggtcgccaaactttttctgtgataggataggtaataaatattttaggctttgtggactatacagtttgtgttacaactattcaaactctgccgttgtaatgcgaaagtaatcataagtgataaataaatgagtttggctgtgttccactaaaacattatttataacactgaaatttgaattttatgtaattttgacatgtcataaaatattatttttcttttgattattttcaaccatttgaaaacgtaaaaacacttcttggctgatgagccataccaaactggcagcatgctaaatttggttagcaggtcttagtttggtgacccctggactagtggatttgcttagccaagctgacacaaccagggagaaaaggcccagtgatttactttggaattatcaaagtaggtcataagtcattagttaatagagaagtactaaacatcccaaataatatatttgaataacttctctagatttattttttttcttagaacatctgacatggtatttttagatgtgtgttcttttcaaacttctctaccctggtatacacaaattctaatgtcaagtgttccatgagtttctaaacatatgctgcttaaaaacatacggcagattttaacgttctttcttaatcttagaattacaataactggaatgaaagggaaattgtaccttttaaaataatttttatgccagctttgcactcataaaattttattgccatcattttaatatatccactgatttacataatacctaacttatctaaaatgcataattctgaatagtcacaaaaagatcagttaaaaattctaacaccttcaagataagactttataaatatcaaagaacaggaaatgtgttctgtaattactcctgatttaggatgcgcagactgagacatcatgttctcgtaaactaccaggatggatcccatctattataggtgtacttcttcatgaaaatgcactttccgttactggaaaaaaaagacatttaatgcaaaactagggactcaacaagcaggccctttataaggaagaaaaaaaaaaaagaaagaaagaaacttttaggattaaaatgctaccacagtagtttatcacctatagtttctatagtttcttctttcaccccagaaaacaccatttccattaagcatttactttctgttgcgatagtgatttcttgtgaaagttttaaaatgtacttcataatttttctcactacattaactgacattacaggtacccgaggattctggaaatattgctgaagtgaaaacaccaccaacaaaactgctgtaaatgagttttctccacttcatttgcagataaaagcttaagatgctctcaccttttcctaatttcagaatccacagtaatctgcctcttcttttggggaggtggtggtggaagttcctcttgagcatgctttaccaggatctgttcccttgtggtcaccgtagttactgtttccattacagttgtctgtgttagtgatggctgagtggtggtgacagcctgtgaaatctgtgagaagtattgaaacagaggtcagacattgctagaaagacttcagtaaagactgcttggagtggcaaaggaaaataatgagaaactgttcttgcttgttggtagattgaccttcagatcaaaatagcaccatattgaagccaaataaaattgttttatctgacttaagtttggttcactgaaatagcaagggaaagtaatctcaacatcgaaagtcaatttagcgccccttcaatatattggtcaaactgtaggaaataaggggtgggggcagaggagaaaaatgtagagtataattcattctgatagttaattctacatgctgtttaaaatgtttacattaatatgaatgttactaacgtacatcagtaccaattccattgcctagaacattttaaatgcttattaatagtttgtagaatgcatttttggttatcatacacattgattattttatgttatacatttttaaataaaattatttcaacttggtaatgaacgactctttaatcaaataagtgaaacagcttttaaaattacaataaaaggttaacataaagtatgtattagtccatatatatctttatgttgaatgttattcaaatgctaaaaaacacactactcttgtttgatttaaattagtgattatgttcaaatatttgagttcccatattcatcactggagacacttcttggtttagaatctcaattacctcctgttcatacttttggcagcgggccgggggcaacagttcatccatctttggaataatacattttgtgagccaagacatgagaggccatcacctcaatacatgggcattacgagatagacaagtcatataatggtgagacaatcattccttatcatattctccgtctcacagagctcctctcatgacgattgtaacgttacctcttgggatggtaatcattatccttctggcaatccaacttatatgcaaggtctgtttccaaggaagtcacaagaggcctgcattgaaactgcctctggttacaagcaaaggagcagggatctggctgggtcaagattcattttagcaattttcctgaatttgccaagaggtaagggaagggtttgtagtaatctccctgcctcatacacgaggactgattcctttcatgtgaggaaatgggaaaagcctcaggatcttcttatttcagcttccaaattggcaatgaacagtgaaggaataaaatcttttccatgatgtcttaagtaaaaattgctttgacatacatagcttaaaaaggctaccttttgttaaagacatatctttacctatgtgagggactgaaggatttccattttggtaggctaaaaggatactaagaattacagtttctacatttgccaagcacaggttttatcttctctaggatctccatagattcattatttagaatgaatcactgaacctcaaacaactttaattataagtctgttgacaagttatgtcaagatgaaagcagaaagcaacatagctctaaaaaaagcttaaaatataaactcaaacattgcacccaacacaaaatgaccattacgtgataaaattagttttatttctagtcaaaaagaaaatgtagtttttagtaggattccaagagcatttactttgtaatttgaatattttttaaccatgagaaaacttgctttgcaaagaaaatgcagtttttagtaggatcccaagataatttatttttttatttgaatatttttttaaccatgagcacactttctttgcatacagtggaggctagaagataatattttgcagattaagaaaatacctaattttaaacatacagaccagaatgcagagattctgaaaataccaagctaattcatgcagttatatccaatctcatagaacatttgtgctactaaaaatttgactcttaaattaatttctgtaatattaatattttcgtggtatctacttataaaattggatacatgtgcccatggagggtaaagggaaatgacaacatgatatactgtgaagcggcatttaaaaatatactcaaccttttaagaaagaaaaatgaatcatttttaataaaagagtagtaagacatgagtctgtaattgttctatataataatcactactacactgtaattgaaaaatactacttcatttccttcgggatggagaaataagaaaactgtgcattcaccctgtaaatatagggtagaactcattacatataacaaattaataatcactctcaaaacctacttcatacaatcagaataaaaaacaatcagtcatgtactaaatttccttatggcttatagttattgactataactattattgacacttaattatgtgttagaatcattaggaaatatagacaggagagggactacgaaggccatttaacatgacctcctgattattacagagctcactactccctgaaacagaaagctcctttcttagcatgcaagcaaactttccccattgggaaagatgttcttaacaaccagaggaatcctgcctgattaagacttcctcttgttaaaacttgttttgagttctgaatgaaagcagagtaaattgaatatcatttctacctgatattctaagatttgaaatctaataatcatgaccctgataaatatcattttcaaactctataatgccagttatttgctagaagtagatataacttgattcgtcatccaaaaccaatgtttcttggctttggacaccatagtcaatcaaagaattctaaaactgtgtaagttattcagcagctgaaccacaaggtttctataaaattctaatgtttattgaatatatattcactataggacattcagaaatgagtaaaatagaaactccatatttaggaaccttacggcaaaatagggacgatgataatcacacaaataattgtgaagatgaatgccacgtgaaaaataccagtatgcaaaataattacatacaccaaacatacagtaatcaagtaattttctctttaaatgttatgaaaacagatttctctcagctagcattttaacatttagatttaatttgatgctgaaggctagatataatatttatccttgtttatagggtctttctaacagtaacttttggaaacaacctcatgtcatagatgatggtttaagtacattatggtatatgaatgtggatggagtattatatttcaaatattttaatgtcattggaaaacgtttgctttacactattgagtaaacaatgctagacataaacattggttgatttttgacagagaaagtagagaaaatttctgttgcacagtgtatatttctgtattcctttagtttccaaagttcttctataagatattatctgcaaaatgttgcatttgtaagcaaagaaaaattttgaaagttttgccaaactgtttgttttaaatctatcatttctatttatatattaagatctatggaatcatactcctgtcactcaatgcattagaatgaggaaaacttcaagcatgataagaataacgtagtgccttcactaaaatgtttaatatggcagagtcaaaactagaatagaatatagtttgacctatattcaacaatctttgtatctagctaactatacttttacccagtcacctttcttcattttgattatgagtctatttaagactctaaaatgatatcatgaaaagaaaatacatttctttttaaaatactattcattttaactgcaagttaatttccctagtaaaaatgggaaatagtttagaaatacttgtctttacatttgggagctgattcctcttagagtggttataagtagaggcattggagccagtctccacaattattaaacaccagatccatagtttatacactgtgacatttggggctggttggttcttatctcaaatctatgcattattttcttcatctttaaagtaagagtaacacatttcttcacaggtgtgttacaagcaaggacagcttcatgggctggtaatttatgcagttgcccagggcccctgctcaggaggcttccatgcttgttttcaagctctgcttccactgtcttgaaattcttaggtcttgaacaggaagcccttgttttcagtttgcactgggcccacaaattatgtagccagtcctggttttgagaattaaatgatataatatctgaataaaataagtgctctataatggtaaatatcagcagtaaccactatcttttctaaacgctcagggaaatttgaagaatttttctatactcaaccttcttactcataagattacatatgttaaaaagatttaaactttaaaatttacattttctcattctgagaaaaattggaagagcatttgccagcatcctgatattattccagggtgtgcctcttcttgcagtaagattgtgttattttgataggcctgggaaaaacaaactatgctcaagaaatgaagttctttctttccatcttctcttccacttgtttaaaaaatgcacatttaaaaaaagaaacataagtacatcaaagcaaatttaaagaatacaaaaggacatacaataaaataaaatactttttttctaccactgtctccagtttattaggaatcactacaagtcatgtataacttaacaactgggacacattctgagaaattcatccttagacaattttgtccttgtacgaacgccgtggagtgtacttacacaaacctagatggtacagactactatacggccaacctatgtggtacagcttattgctcctagctacaaacctgtacagcatgtgactatactgaatagtgtaggcacaatggtaagtatttgtgtatccaaacatatcgaaaggtacaataaaaatatgatatagagagttgggcataaaacaatctttagaaaatttttttaaaacccacaaaattataccaacaacactcttggaccacagtgcaataaaaatagaaatcaatgttaagcaaattgctcaaaaccatacattaaaatggaaatcaaacaaactgctcctgaatgacctctgggtaaacaataaaattaaggcagaaatcaagaaattatttgaaactaatgaaaatttaaaaagatgtaacataccagaatctctgggacacacacaaagcagcgttaagaggcaagcttatggcacgaaacacccatatcaaaaagttagaaggatctctaattacaaaacgaacatcacaaggaacgagaaacaatagcaaactaaccccaaagctagaagacaggaaataaccaaaatcggagctgaactgaaggaaaatgagatgcaaaaaagcacagaaaaggtcaatgaatctaggagctgtttctttgaaataattaataataaagatagaccactacctagaataataaagaaaaaaagagagaagactcaaataaacacaataaaaaatgacaaaggggatgttaccattgaccccacagaaatagagaaaacccttagagactattcataatgaacacccctatgcacacaagctagaaaacctagaagcaatggataaattgctagaaacttacaactttccaagtttgaaccaggaagaaatggaatcattgaacagaccaataatgagttccgaaattaaattaggaacaaaaagcccaccaaccagaaaaagcccaggaccagacagattcacacctgaatactaacagatatagaaggaaaagctggtatcattcctatgaaaccactcccaaaaattgaggagcggctccttcctaactcattctatgagggaagcattgtcctgataccaaaacctggcagacacacaacaaccaaaaaagaaaacttcaggccaatgtccctaatgaacatagatgcaaaaatagtcaacagaataccagcaaacccaatccagcagcacatcaaaaagctaatccaccatgatcaaggagcttctatcccagggttgcgaggttgattcaacatacacaagtcaataaatgtgattcaccacataaacagaacaaaaaatcaaaaaccacatgatcatttcagtagatatagaaaaggcatcctataaaattcaacaccctttcatgttaaaaatcctcgacaaactaggcactgaaggaacatatttcaaagtaattagaaccatctttaaaaagtccacagccaacattatactgaatgtgcaaaagccagaagcattgtgcttgaaaactggcataagacaagggggccctctcttacaaatctcattgaacatagtactagaaatcctagccaaagcaatcaggaaagagaaataaaggcaatccaaataggaagagaggaagtcaaattatccctgtttgcagacgatgaggttctatactttggccatagtctctgcccaaaagctcattgatctgatacacaacctcagcaaagtttcagcatccaaaatcaatgtataaatatcactagtgttcctacacaccaacaacatttaagctaaggccaaatgaagaacacagtcccattcataattgtcaaaaagaaataagatacctaggaatacagctaagcaaggaggtgaaacactgctaaactgagaattacaaaatattgctcaagtaactcagagataacacacaaaaaatggaaaaatattctatgctcatggaagaatcaatattgacagaatggccataatgcctaaagcactttttaattcaatgctattcccaaaaaactaccaataacattcttcactgaataagaaaaagactatttaaaaattcagttggagccactaaaagagccagaatagccaaggtaatcctaagcaaaaagaaaaaagctggaaccatcccattgcctgactgcaaactatactacaaggatatagtaaccaaaacagcatggtacaaaaaacagacacataaaccaatggaaaagaatagagagtcgagaaataaggctgcacacctacaaccatctgttcttcaatgaaatcaacaaaaacaagcaatgggaaaaggactgcctattcattggaccccttccttacaccatatacaaaaattaacccgaggtggattaaagacttaaatctaaaaccaacaactataaaaacctaagaagataacccaggtaatgccactctggacattgaaactgcaaagacttcataacaaagacaccaaaaacaattgaaacaaaaacaaaaattgaaaactgggacctaattaaactaaagaacttctacacaacaaaagaaactatcaacagagtaaacagacaacctgcagaatgggagaaaaattttgcaaactttccatctgacaagggtctaatatctggaatctacaaggaacttaaatttacaagcaaaaaccaaacatcaccattaaaaagtgggcaaaggacatgaaccctttccagaaaaagacatacatacagaaaacattcatatgaaaaaatgctgaacatcaataatcattagagaagtgcagatcaaaaccacaataagataccatttgacaccagtgagaatggctattattaagaagtcaaaaaatcacagatgctggcaaggttgcacagaaaagggaacgtttattgcactgctgatattagtgtaaattagttcagccaccgtggaaagcagtttggtgatttcccaaacaacgaaaaccagaattaccattcgacccagcaataacaattattgggtataccaagaagaatataaatccctcaaccctaaagacacatgcacatgtatgttttattgaagcattattcacaatagcaaacacatggaatcagcctaaatgcccatcagtggtagactggataaggaaaatgtggtacatatacactgtggaattctatgcagccatgaaaaaagagattgtgttctttgcagcaaacatggatggagctggaggccattatcctaagcaaactaacacaataacacaaaatatcacattttctcacttctaagtgggagataaacattgagaacacacggactcaaagaaggggacaacagacacggtggtctatgtgaggctggagggtaagaggagggtgaggattaaaaaaactacttattgggtactatgcttattacctgggtgatgaaataatctgtacaacaaacccctgtgacatgcaatttatctatatgacaaaccaccacatgtacctctgaagcaaaaataaaagtaaaaaataatatagtataataatattatgagaccactgtcatatatgtggttcattgttgactgaaatgttgttatgcagcatatgactgtagttgcaattacgaactattcagctattctttaattttaaattcattttgtttatgctgttattttatgatatggtttggctctctgtccccacccaaatcctcatgttgaattctgtcttcagtgttggaggaagggcctggtgggaggggactgaatcatgggtgtggacctcccccttgctgctctcctgataagagttctcatgagatttgtttgtttgaaagtgtgtggcaacccttgccagatcgtggccagtctgcttctttaagtgggaccctgatccatcctcctcactgggtgggacctccctgagggggcttcagccattccacccaggattcaatggatagagctctgatctctccctgggacagagcttctgggaggaagaccagctgccacctctgcagttctttgaaactaatgagaacaaagagacaatttatcagaatctctgggacgcagctaaagcagtgttaagagggaaatttatagcactaaatgctcacatcaaatagctagaaagatcttaacagcctaacatctcaaataaaaaaactagcaaaccaagagcaaacaaacaagaaataaccaagatcagagctgaactgaaggagataaagacatgaaaaaccctccaaaaaactaaatgaatccaggagctggtttttggaaaaaaataaaaataaaaaaggtagacttctagttagactaataaggaagaaaagagagaagaatcaaataaacacaatgaaaaatttgaagaggaatatcaccaataattctacagaaatacaaacaaccatcagggaatactataaacacctctatgcacataaactagaaaacctagaggaaatggataaattattgaacacatttctcccctctaagactgaaccataaaggaaatgaattgctgaatagatcaataatgcgttctgaaattgaggcaataataaatatcccaccaaccaacaaaagcccaggtccagatggaatcatagctgaattctactagcggtacaaagaagagctggtatcatttccactgaaactattccaaaaaaattgaaaagaagggatttctcccaaacttatattatgaggtcagcatcaccctgatgccaaaacctgggagggagggagggagggagggagggggagggagagagagagagagagagagagagagagagagagagagaaggaaagaagaaagaaagaaagaaagaaagaaagaaagaaagaaagaaagaaagaaagaaagaaagaaagagagagagagggagagagaaagaaagagagagagagagagagaaagaaagagagaaagaaagaaaagcaaacttcaggctaatatcattgatgaacactgatgcaacaattctcaataccagcaaaccaaatccagtagcatatcaaaaagcttatccaccacaatcaagtttgcttcatccctagcatgcaaggttagtttaacacatgcaaatcaatacatgtgattcatcacataaacagaactaaagacaaaaaccacatgactatctcaatagacaaccaaaaggtatttaataaaattcaacatcccttcatgttaaaaattctcaataaactaggtatcgaaggaacatacctcaaaataataagagccataaattataaacccacatccaaatgggcaaaagctagaagcattccccctgaaaactggcccaagataaggatgccatctctcaccactccttttcaacatagtattggaagttctgaccagggcaatcagggaagagaaagaaataaagggtattcacataggaagagaggaagtcaaattatttttgtattcagatgacatgaacctatatccagaaaacccccattgtctcagcccaaaagctaagacttcaaactatactacaaggttacagtcaccagaaaagcagggtactggtacaagaacagacacatagaccaatgaaacagaatagagaactcagaaataagaccacgcacctacaaccatctgatcttcgacaaacctgaaaaaacaagcaatggggaaaggactgcctatttaatacatagtgctgggatagtcctatgcagaaaattgaaagtggacttcttccttacaatctatacaaaaattaactcaagatggattaaagacttaaatgcaaaaccccaaacaataaaaaccttagaagaaaacctaggtaataagattcaggacataggcatgggcaaaggtttcatgaggaaaatggcaaaagcaactgcaacaaaagcaaaaactgacaaaggggatctaattaaactaaagaacttctgcacagcaaaataaactaccgtcagagtaaataaacagcctacagaatgggagaaaagttttgccatctatccatctgacaatggtccagagtctacaaggaacttaaacaaatttacaagaaaaaaacaaataacctcattaaaaagtgggcaaagcacataaacaaacacttctcaaaagaagacatacatgtgacctaaaacgatatgaaagaaaactcaacatcattgatcatgagagaaatgcacatcaaaaccacaatgagataacatctcacgccagtcagaatggttactattaaaaagtcaaagaacaatagatgctggtgaggttgtggagaaaagggaacacttttacactcttggtgggagtgtaaattagttcaacccttgtggaagacaatgcggagatttctcaaagacttagaggcagaaaaaccatttaagccagcaatcccattactgggtatatacccaaatataaatcattctattataaagatacatgcatgtgtatcattgcaacactatacacaatagcaaagacatggaatcaaccttaatgctcatcaatgatagacaagataaagaaaatgtggtacatttacaccaaggaatactataatgccacaaacacgaacgagtcaaacttcttttcttcataaatcactcagtttcaggtatgtctttatagcagtgtaagaacaggctaataaattttccttttatttttgactgatattcttaattgaaacttttaactttccatttaattatttacatattattgcctttgtaacttttttgttatgctgggataagagatttcaacttcttgccttttgagatattctagtatttgaatatttagatacttactagaaagattcaagctataaagtattagttactaatttagcataaaatctttattttgcaaatactaatacttgcaataacaggtaccagttatgaagctttctgcatgatccaggcattacaataagtgttttgaattgattatcttattcaaaagatctagaaaaactcccttgctatgttgtaaagctttaataaatggtagctattatgacctcacaatggccctaagagtaagtactaatattattcctattttatagatgaaagtgaccttgttgaggcagataaaactttttagtagcaaagcatagatataaatccaagtctgaatgttcattcatccaactcttatcagctatgctcacttgctcctacacttgtacacttttttgaatggtggtttccttttaaggggtgtgtatttgtatgcatacacacacatatataaattcagaatactgaaattgtaaacaatggcacatcataactattatataggaagaattactcaatgttaaatatgtttggctcttgacatgctatattgaaatctgtgcaaaattagtcaaaatacactacacacacacaatcaggttgacaactgtggatcaaggcttttcattgcgttgtctgtctatgtatatgtaaccctttggagtgatcaataagttttaatgggcatggaggaattgcacttctgcagtttaaaacatactgcataatcatagcaacagctttagataataattgatagccatgcttaaaaaccaactccacaggcatggtagcacaaggcacaaaaatctggtaaagatttgcatctctaagcaaaagaaaatatttatatgttgaactttgggagaatccttgggcaaaagatcagatggtcacaaaggaagctgagttactaatcacaaggatgtaaaatgctttatcttatgaagtatagaggacttcccatagctgaatgtagcatacaatgagtgccaaagttcaggacagtagcctggtaactaaaatttactattaattactgtaattaatttattattacaataatttaataataatttaatttatattaataattaatttattactgtaaggtaataaaatttcttgaataagtactgacattgaaatcatgagcaaaattattgtcaaatacttagaaggcatcataagtcatttgtttcttcgaaataaatattatatgataattaagaaggtttattctgtaaaactgtctgtccaatttaatgtattttgttcctcattttaaattgtctttagtacaaattgtatcagaaagaagagatgtatgttgtcttctggattcatattaaatacggaatttgagcaactgtgtgaattaactgcacctgcaaaaattgcaaagcaatgagatttaatttttctgatccatctggccttcctctacataccatctaacactgaagtaatgaaacacattctataattagggatggatattatcaagtataggcttaggaaaaagacttgtatttgtctttatgtgttatttcatttttttgtcaggagataataggcgtatcatacagatgctgagcattttgtctgtatggtattttaatgacatactcagtgaatacagtgtaataatttcataattaagtctcctttgaatagggataggatgttattatcattattttttagctgcctttccagtggcaaaagtaggaatcttcttcactaagtactccagagtttcacataaaagcaaagagaaacatatcaaagacatttagaactcgatggccactatagaaatctgcctagcttacctttcctttaaatttataaataaagaatgagagattccaagagttaactcagactgaatgtattaaattttttagtgcttacattttatattgttacagacaatgcatttacaaggtaaaacctattgcactgatatacaaggcccattctcaaatacctattatagttggagatagcaaaatgatacagttaatttccaaagttatttgagatgtaacttcaaattttcttttttttttttttttttttttttttttttgagacgaagtctcgctctgtcatcccggctggagtgcagtggcatgatctcggctcactgcaacctccacctcccgggttcaagcaattctcctgcctcagcctcccaagtagctgcaattacaagcgcctgccaccatgcctggctactttttttgtatttttagtaaagatggggtttcaccatgttgaccaggctggtttcaaactcctgacctcagatgatttgcctgccttgtcctcccaaagtactgggattacaagtgtgagccaccacactcggtcaacttcaaatttttctaataaaactttaacctgaggaattacccaaaacatgttctcaaatttaagggagttaattctatgaccttaagtaagaaggaaacacaaaataagtaaggtatttttattttaattccagattttaaaaaattattttcttttttaattggcatcaggcttactagtcgtggagagctttcaggaagcaatgaaaaggtcttttaaataaaaagccttagagtatttttaattaaacttactggccaaaaaagaagagaggcaaaccatttgcaactatatcccccttgtacaaagaggtctacaaaatgatgctctgagaatgggtacagccagaacgtgaacataaaatattttatgaagggttaaaatagaggatctttaaagaatgagaattaactcagaaaagaagaacatgtaaagaaattttcatcttggtacattggcatatttctatttgcattttgggtataataaaaagcactggcttatcatttacagctatgttttatattactatttgataggagttttaaatctcccatcaggtgcttgcttcggcagcacacataataaatctctcatcaggatatagatgatatagaaggtacacataattatataataatcattttctctttttgggcatccttgaatgtaggcacaaacatatacagcataaacatgaactgccatgtacaagaagaggcaaattctgagcatatgtattttatcttaaagaggtgctcacagttgagaatgttgcaaaaattgttgttagcaatatagcaaaatattcacaaaatgggaatgagatatttgaaccttaataagtcatacaactttccttattcctgagaaagaagacaatttattctactaaaaatccacaaaactacaaaacctttagactcgcttgaaaaaaaaaatatatatatatatgcttacaccaaagcacctggtatatactacttaatataaattacatattaaatacagtaattacaatttatggcgtaatatgataattacaattagcataccaaattgtaaagcatatgactaatataccctttcaacagcacatgtgatttcagtcaaatgaggaaagtaatgcttcaaatcacatacattatattttaaaatattaattataataaatttcttactatcacatttatttttttaagttccagggtacacgtattggatgtgtaggtttgttatggaggtaaatgtgtgccacggtggtatggtgcacctacagacccattaggtagatattgagcccagcatccgttagctatttttcctgatgctctcctcctctcccagcaacaggccccagtgtgtgttgttctcttccctgtgcccatgtgttcccattgttcagctcctacttataagtgagaacatgcagtgtttggttttctgttcccgcattagtttgctgagaataacagcttccagctacatccatgtctctgcaaaggacatactctcattcctttttatggctgcatactattccatggtgtatatgtatcacattttctttatccagtctatcattgatgggcatttgggttgattctatgtctttgctattgtgaatagtgctgcaattaacatacaaatgcatgtatctttataataggatgatttatattcctttgggtatatatccagtaacggccttgctgggtatttctggttctagttctttgaggaaccaccacactgtcttccacaatggataaactaatttacattcccaccaacagtgtaaaagcattcccatttctctgaaaccatgccagcgtctgttgtatcttgactttttaaaaatcaccattctgtctggcgtgagatggtgtgctgaggctaatatggatgaattgagagaagtaggcttcaaaggtggataataacaaacttccctgagctagaggagaatgttctaacccaatgcaaacaagctaacaaccacgataaaacgtaacaggagcggataaccagaataaccagtttacagaggaacatgaatgacctgatagagctgagaaacgcaatacgacaactccacaatgaaatcacattgtcaatacctgaatagaccaagcagaggaaagaatctcagagcttgaagactatcttgctgaaataagacaggcagaaaagattagagaaaaagaaaagaataaaaatgaatgtacaaaacgtctgacaaatgtgggattatgtaaattctgaagcaaagactgtttggggaacctgaaagagacggggagaacggaaccaagttggaaatcacacttcaggatatcatccaggagaacttctccaatctagaaagccagccaaacattcaaattcaggaaatacaagatactcactgagcagaagccagcccaacattcaaattcagggaatgcaagatactgagcagaccaaccccaacatacgtaatcatacaattctccaggtttaaatgaaagaaaaaatgttaaggacagccagagagaaaggccaggttacctacaaagggaagcccatcagggtaacagcagatctctcagcagaaaccctataagccagtagagattgggggctaatattcaacaccgtgaaagaaaagaatttccaaggcagaatttcatatccagacaaagtaagcttcataagtgaaggaagaataaaatcttttccagacaagcaaatgttgatggaattcgtcactatcgtatttcataattatgatcaagataaaatatatatcgatcagggccaaggcaattagaaaaaactgcacaaattacaagtatgtttataaaaaattacagggaatcatgatcatttgagtttttaaagaagtcaatccagggtatatttgccctcttttctcattgtaagcctccagatagcaagagttattatctctccaacatttagaaaaaaagtattttctatcttcttaggctaccttctaatcaacttaaataccctcagcttgtgtccaggtattattcaagtcaaatctgagtttgaaatgcaagagagcagtcctcctagctgattattttttcacgttttgatctcttgccatgcaactgcttcaaaaggtcaaaaatgcctcaaagctctgacctgaacagcaatcatacgcgcaagcagtgttctttatatgagtacaactgggtgccttgtcatctcaatcacgatttccacaccctgcctcacaataggttttaaccattatgagaactttgctcattctttatactaattatttaaaagaatttttgaaacaattgagtatatcatgtgagtagtcattaatgaaactcatttttctcccacaatcattatagaaaatgtacatacaagtgagctttgttcttcaaagtcacaaccttacagctcatattcttggaattctccttatgtaattttaatcaaggtcaatttaacatggataaaagaaaatcagttgctcttatatgatactatttcgctgttgtctctgtttacctccttttaatttctcttttcctgagtagctccatttctaccttcctgtgagctcaaaaacagccagcaaagatttggatcaatcccatgacagcataatttttggaaaggcaatgagagaaaactgaaacataagcttaagaaaaactcaagcttagtgttctggaaaacaacttacatgatgttaagtccttttatttatttctagcccacaataggagcgtgtaactgtttgaaaataaaattaaaaggagatagtgggccgggcgcggtgacttatgtctgtaatctcagcactttgggaggccgaagtgggaggatcacaaggtcaggagatcgagaccaccctggccaacatggtgaaaccccatctctactaaaattacaaaaaattagtggggtgtcatggtaggcacctgtagtcccagctgctacttgggaggctgaggcaggagaacggtgtgaacccaggaggcagagcttgcagtgagctgagattgtgccactgcactccagcctgggtgacacagtgagactccatctcaaaaaaaaaaaaaaaaaaaaaagcagatagagaaccacaaaaagccctccagacacactgaactacatgacttacatatcaaactcaacctttttcccctcaaatgctttcttgtctatgcctccattttatcttcattgtatccctatgagcaagtgaagagatacatgctgtaatgcatgttggactttatttcataaagaaccatgcaaatcaaaaccagtattcttttattatagaattatacaagttggaagacatcacgtcaattgcctaggtggtggtctcataatttctagggaattaaaaataaggcttcaaatgcttttctaccaattggaataatcaaatcagtaatatttcgatgacatgtacaaacttcatcaaaaagtagtcccattccaagggaatgagcatatttatatagtgtattcccaagaagctctcccttttcacatttcagggagcattgtggaaaaccagaatgttgggattcacacacatatcactgtctattttctttaaacatttattttaggctcaggagtacatatgaaggtttgttacataggtaaatgtgtgtcacaggggtttgcttaccaattatttcatcacccaggtattaagcccagtatccaatagtcttatttactgctcatctacttcctcccaccctcccacctcaagtagatcccagtgtatgttgatcccctctatggtctgcagattgtatcaaaggcttagtaaagatgtagatttttaggtccttatcacagcttatggatgagattttctgagcaaaatgtttaggaatatgcattttaattagctcctcaggtggctactatgcagactcaagtttgagaaccactccatgcaatgcaaatgaactagaagatgacctacagttaactgttacagctccctaaacatgtcccttaaaagggatgcacgtcaaaataactttctttatcaaataatggcaatctttcttaacacggcaactgaccattttatggcagcaataatctgtggaagcaatgggtacatatgggaatactctcagtgttgggttaaaaagtatcaaattgactaatgtctcatgtatttattacataaataccaatgtattgcaaagaagccatgggcagatcacataaaacaggaggaatcataatatagtactaaaactactattaggtcaattaattgctaaagtatgtttaatggaaaacaaatggagtttttattatgtaatgattgtgtgggaaattattacaatttatattcatatttcttcaaattataattttttaacgtaaaattggattaaaagtaacattgaactgtgattgaaaatcatataggctggtttattacgctgtcttaaattgtattcctggaggcaatactacaaacttcatgtctccaaaaggcatttcctaagtgctacttatcagatgtcaggtctcaagaaaacaaattccatgtacttgtctcaatatagaggaaatatttgcctaaaatctattgaatatggaagtgtatgcctgtgcattgagctatgaattttgagtaaagttattccttataatgccaggctatgtggcagaatatgttaaatactattatatataatgtttatatcttgaatgactactcattattctaccatccaactacataagacaaaaagaggttcaacttttaacgataccccattttagtgactaaatctttaaaaattattataataaaaccacataccccaaatgtagctgagatgttttcataatctacagcccgtatgtgttagtataactaagccacattcataattttatgaaatcagcagtctatggcagaaaaggtacaatagtcagataattaactacactaataaaaaactttccaagaaatcaaaagacctgaaccctagttctcctaccactaacttctcttgaaaaatttacttttcttccctaagtttcatttttctcaagagtaaaacggagttggctaatgttcctcgtggttctagcaatctctgatttggggttagactgtgattatacagttcccagcattttgttcgcctgctctaagtcactcagttccccgttactattgggctggaagaaattcactctagggcagtaacaagttcagttaattagcactctacctcaccaccattctccaacaacaagacaggcaaaagaatcatgtttttatttaactaaacacagggcaaaaactaatctggttgcttcttttgtagggttataatgtcactctcttaatgcaggtttaaaaaatctctgagatagtctgtagcatgataattggtatcactaacctgtgctgtactcttttcaagtttttggactaaattatcccaacaccgggcaaagttatccagccatgcttccgtcttctgggtcactgacttattcttcagtgttgaaagaagatcttgtttgagtgaatacagtttgcccatggattgctttttcttttctagatccgcttttaaaacctgttaaaacaagaaagatcacagaataagcctgggttgcattccatacaccactatagttcaatctgcttttgcgtgtatttgctcatttgcatagataagaaaatatttcaatcgtgcccgcaaaggatcaaaagttcagaaaaatagaggtagaaagttataatctatctaattatcccaagaagtttgaagagaaaagaagagaaaagaaactcaaacgtagaataaagacctactagaggtaattaagagctaccttgaaatatttgaagaaaatccaagtgaaaaggtaatattgcttcaaaaggcaaaacagagatcaacatgtggaaattagaaggcacggatcttggatttccccttaattcctgacggaattcaaacgaaaactgacaatcaggtaccaggagtactgaagaaaagctagtgagctgagaaaatgagaatggctaaggaaacttgccattctgaaatgctgtgattatttggataaaattacaatattattgtttccacagttttaacattcggttcattatttggagataaaatctcattatgtgatttactgaccataaaatttttgtagcatccattaatcaattaacatctggttatttgagtaattattttttaaaactaattgtagagcccattaagtaaaagaactaagtcgctgggcatgacataaatgcttcagcatctcttttcagagtttataaatacttatgtgtcttatgaagcaatttttataccatttatatttccaaagttcctgtgagctgtggagggttacaaactccctttggttgatttgaaaggaataagtggtttatgtgaaatcagtaaatcagggcagtttttcttttacttgactcagtaactttgcctgatacacagacaaattcaattcctgggtactgaacattactccctgacttaatctgtaaacaaaggagaagaaggaagagaaataaaggagaaaattatcttacagccacttaacaaccccatatttggcagcaaatacaatgaatgtaaactaaatcgcgatacctgtctttccgaaacaaatgtaagtttatttaagaactaacataccacagagcaaattgtcatgacacaaatgcaccaattgcccatgaagcaaagtgccccaaacctagagcagtcaatacaccttcctgaaaaggacaatctaagtagcccattttggcatggcacctgcattgatagctctgaactgcagaatgctctagtggctccttcaattagtttgtcttttactcagaatctgcttcacctggagtatgttatagttcagtcttcatgccatttttaaggggaaacaaagcaagatttaagtttcatctctaatttttccttaacaataagttcagtatttttctaagtttgaaagaatgcaatagaccaaaatacaaattaagatattatacactgaattcaaatcaaaataaaactcacggtgtgggggtttagcaataggtaggtggtttttcttttttgttttgagttggagtctaactctgtcgcccaggctggagtgcagtggcatgatctctgctcactgcagcctctgtctcccaggttcaagcaattctcctgtcagcctcacgagtagctggtattataggcacatgccactaagcccagctaatttttaaatttttagaagagacaggagtctcaacatgttggcctggctggtctcaatctcctgacctcaagtgatccacccgccttggcctcccaaagtgctgggattacaggcatgagccaccatacccagcccaatagataggttttgcatattcattttgtttaattcacttgttagttttccattaaatttaagtgaatatttgcattagtactagaacaaaggttgatgctacctgtcccaagctgagagccatatttgaatttcaatgtatattcctccagttatagtgtcattttttttctttactatggaaagaggcacaatatacacaaagacacaaatctaaaaataaaaaaaaaatctaagtacaatcctctttgacttacttactcagaatgttagaaactattttaaatagccatatgtgtaaggctgaatggtctacccattatttaaacaaaatatgtaatgatttggaaacatgtcagaagaggagtgtgagaattatgtttaaagaagaggattgcaataaaaacctatgagtaacctcatggtacctaaacaaatgaaaataagcctcctgttttattattaagccacatgaagaaacatttggtaagcattacaaaaatgaaagtgaaagtcaccattaaaaataaaattagaggtggtggctcacgcctataatctcagcactttgggaggctgaggcgggcggatcacgaggtcaggagttccagatcagcctggccaacatagtgaaacctcgtctgtactaaaaatacaataattagctgggaatgttggtgcatgcctgtggtcccagcgactcaggaagctgaggcaaggaatcgctggaaccagggaggcagaggttgccctgagccgagatcacaccactgcactccagcctgggcaacagagcaagactccatctcaagaaaaaaaaaaaaatccaattaggaaaaaagtgcactcaaggtaaagtaaaatcaatgttataattacattgtgtgattattgaataaatgaatttttatatgtctgtatgacaaaaacactgaacccagacttatacctagtaaattttagatatgagtatcaaaaatgatgatggcagattagttgtttggtctcagtttctctctctttttctgtctttcagtagtcatctcccagttccagaactcccccaggattattaactgagggaggaaaagaaagaaaatccatgatggggccagatacattagatcatagaattcattagaattaccttgtcctgtctatccattgatgctgattcttttaagcttaggtcttacatgtgcatattaaataactatgatttgttactaattattgcataaaatatgtatttctacatatcaataattaaccataggtctatgagtgccagagacccatagagctctagaaaattcaggtggcaaaaggaagatctagagaatgtgtacaaggcaaaggccagctgggatagtaaaagaataaacagactttatttttatagaagccaggaatgtagacctacctccaaggtagggaggaaggtacagtcaataaatcagactgggtcagtagtggatatggagaagagacagataagctgttcaagatgatttgaagtgaaaagataatgtatccttacaaaaggcccaggaaaccttcacctcactctcatcaggaatacgcataagagaataatgccaagacaatttctcctatattggcaaaattgagttttccacctatattatgtgtagttacttatctacatgtaagatgtgctccaattcattctaatcaccagttgtactttgggaggttgatctattacagaggttctcatcttgaaagaacatcagaattacctgaaaggcttgttagaatgcagatgactaggctccacttccagagtttctaaatcagtaggtctgaagatggcctaacaatgtgcattcctaacaaatttccttgatactgatgctgccggtcgggggaacacattttgagaagcattgatcctgtctgaattaattatttgagggccatcccaggagttgaggtaaaggtagcaagtcaaacaggaacttgctcagttaccatgagcacttcatccatgtcctttgatcccacagccatttgagaatatcttcaattcctaagtacttctgtagcccttatataccataatctcttggatcaccctgcttccccagagctgtccttccccagcaaacgccaacagtccccacagcagaaatacatttactcaggaacaggtttcttcttgacttggatcttcccacgataatttacgtgattctacaagtcttataattcacctcataaaagctactgtttcttctttcccttcatttttatccctgatgccaaatcagtttaaaacttaaatcagttttgattataaaaaataatagatctacatgatttggatatgaatcccaaagatctagagcaaattaaatgtcataatccccacctcccacctcaatggcaagcaggacacaatcccatgggttatcagtgatactattttgaaacaaattacacttattgtaaagagaagagagtttagcacagtgtatctatacctagacatgtagtgaaaactggtgacagatggtacctgttttgggtctcagattgtgacatattttaatgaacattaaattcttattcactgcctgagtcagcaaaggaattttacctcaaattctagaccagctgtcaggttttgttaattggcttaaactatcaaatgacaagacctatagaaaacatattttctctttgttcacaagcaaggtgacataacacaaattttaatcctattggaaaattattgactttcttaaaagagcatttttatggccctgaggctagccaagatttctgctcacaaaaatgttaacatagaggcacattattgttagaaatgacagttctcagttgcagttattttttccaaggaatcaactgatatgaggactactgaaatagattgaaaggcctggacctgagtctggatgtcttagtgttcattttaagtctgatactaatgttgtaggatacagatcctgtgttttttcttgatctcgattttctcttggaaacaaactgagtagatggtcctaatgaactttacatgtgtaatgagattgaagaaacactagatgagatgcaaaatctcatctagctttaacatatttggattttgtcagtttgtggcttcctaagaacaactttcttgattggtaaatctagtcaacaatatatgcaggaactttgactagatattaagatttggaatttatcatcatgtaaaataactgtactattctggcatgtggtactttccaaagatggctgtaaaatatcctcatctcagatgctttgctataacttgaccttggtgtttctccatgaggaaatgaaatctaattcccttttccttgaatctgggcaggcttgtgactttttcagcacacagaatatgactgaccatcaccattatgattgaccgtctgaagcacatgattctgtatttaactagcaatatatcttcgctcctaatcagagggcatgactgcattttgataatcagtggtcactcacttatttactgaaaggattcacattttgcctgagaagaacaatgtttgtaaggaatattctgctttaaggagatgtaatccatgcatccattcctctagatatgatagaatccctcatgaatttatcctctcctctctgtggcatgtgacagtgtgtaccacttcctacttttttgaaatctttattctcctcacttttgtgataccactttccccttgtggtatctgctcaatcttttggtcaacatcttatcctctgcctactccttgattgtagacattcctccctgaaatctattcgtttcacttaatgtgtcactctacacaatccctcagaagcattttgattgcttctgaatcaataactagtcatgaaccattttctgagattctagttgtgtaaaccaactgattaatggaaaggatttttaacttggatgtctcaaagacattttacacggaatatatccaaatctgaaataattatcatttttgtcattccagcaattcctcttctattctcctgttagggctaataaccctcctaggaacccagtcacccaaatgaaatgtctaggaaccatttcaaacttctgcctcttatcacaagtttcattcatcacatcttaacattctaatgtttctcttcttatcttaatgcccaatgctacttagttcaggtcttctgattagtcctcgtaccatcaaacatcttcctaccaaaaagaattacaaaaatgcaaatatgattcttttgcaaactctcaatggctccccatcagctgcaggccaaaactacaaatacagctgatatttttgcactcgtgttttcaaacatatacaggttacttttctgaactctattttcggcagtcacatcacttaataaagtccatattctttgagcaataatttcttatcaataataagctagcttgtaataacaagtaatacataagtgaatctattttaaattaaaagaccaatgagggttagcatttatggagcaaaaaaaatgtatgaaacaaataaatagctggtaaaatggtacgtatttaaaatgagtggaaaaatttacttaagtttagaaattattgcattattatgaagtacaatgcaataataaaggtgaaattatggaacactacttacaaccattttgttttataaaagttcatatcaaatgaacatttaatcaaatctatcaaaaattttaagaaatcataaagtagaatatgtcacgtgaaaaattaaactcatagtatcagaccggcctcttttactagaaatgataaaattcacagagtaagagaaactttagagtttttttttttttttttaaatcttggaaattcctgctgaaaccaaatgcttcaatgaagtcttttctgaaatccatttattgccaaagaaatctcattctcaaaacactcgaggtatttataatcaatgtcatttgataggctttaatttttttttgcttgaaaaactaggtgatattgtttggatctctgttctccaaatctcatgttgaaatgtgattcccagcattggaggtagggcctggtgggaggtgattggctcatgagggcggatgtctcatgaatggcttagcacaatccctttcatgatgagtcagttcccattcagttagttcacatgaaatctggttgtttaaaagagtctgggaccttcctcttatctcttttgtttccactcttgcaatgtgatatacactggctccccttctccttctgccatgattgtaagcttcctgaggcacttaccaggagcagatgctggtgtcatgcttcttgtacagcctgcagaaccatgagccagttaaacctctttatttcataagttacccagtcccagtctcaggtacccctttataataaactaaggttaaactccatcaatgtcaggataaccgtcgcttgtaactctcacatattattctgagaatcaacgtcagtctatttttttagaactatgctgcttagaactttatgaaaggctcacagacatttcttagtattactttattaattttaattgaagtcttattctggtatgctatgttttatcaagagtacaactttgaaaaacaaagttgaaaatccacctatagttttttcccactttaattcagaaaagtagcaatataacatctttgaataatctatgatccaagcaaaaataaacatttaatattcaatagcatagaagagactaaataatagtgataatatacagtactgggtttttataagaccattgaaagctagaaagtacatacggccagtttttgaagacttgataacatttcattttgatctttaaagccagttgtgtgaatcttgttcactgcatcttctttttctgaaagccatgcactaaaaaggcactgcaagacattaaagaattccaaggaataaataaacataaatctttacttttccaatttaatatccccccgtgtcttttacagctagtttctcacacatgacacacctgttcttcagtaagacgttgccatttgagaaggatgtcttgtaaaagaacccagcggtcttctgtccatctacagatgtttgcccatcgatctcccaatacctggagaagagacaatcaagcacagcatcagcaaacaattggtaactacgttttattaaaaatggcatgaataatttgccaaagtatctcagtctcctatgtacgctagaagttggaagggacactctttctgatctgcttacatttaaataagtggtgtgactgtcatttgtctttatctcaccaagtcttgtacctttcatagaaaagcaaagagacaagcaatatgaagtggttattataccactatataaaatggctccatagcaaatgtaagataacaaagacatacatatagagaggattttgcagtgagaacaagtaaaaggtgtattttccttaggtttgaaaatacaccctaaagaataaaagtctaactactaaatagaatgcctcaaaagactcttaattgaaacaatcttgcataatgagaattgcctaccatttggattgtagaagaaaattcttagtaacttaaattctattactatgtagatttttcaattttctcaattattacaaaagtattaaaattttctgtttctaaactactctagtgagaaaactaacaatctctgagtaaaaactactatatcattaacatgtcactaatgtctaagaacacacactattttaatatgtaacataaaccaactatcaatgatttttggaaggaaaacaaatattgtgatgctttctatgcaaaggaagcatttcaaaatggcagttagctcaacctcattatgatgcactttatagcctgaattttcaactttttgtaactttttcatataaataagaaacttattttctcatatatatattggacctttaaagctagaaatcataaaatattgacgtgctttattttatatagaattagagttagaaaaatgtttataactcatatttttgaaaaatctactcagtgtctaaggtctcataatttctatgttactttatactacatatgtgtattaacccacctagaggatattaacacatgatttaaacaatgcaaatgaaattagcatcatgaaaataatccacctattttttttttttttgtagacagagttttgctcctgtcacccaggctggagtgcaatggcactatctcagctcactgcaacctccacctcctggattcagggaattctcctgcctcagcctccccagtagctgagattacaggcatccaccaccatgtctggctaatttttgtatttttagtagacacggggtttcgccatcttggccaggctgctctcgaactcctgacctcaggtgatccacctgcctcagcctcccaaagtgatgggattacaggcatgagccactgcacctggccctaatccacctatttctaagtgactaggagagtcacgtttcttaaattgtttaatctatcaccacttaaaaaaaaatacacgcatgggtaaacagaaggcagtcaacattttcctacagtattaacataatcatgtacttatatgcagctcaatcataagtgagttttcagtttttcttcataaatatcaatgttattgctttcagcataatgtaactgttaattttttgtagtttcactttctactcaacttattttgaattatgtttacaataaaagccatagcgctcaaacagtgatgcgagatacccacaggaaatgtgcgagcttaaatcaatgaatttagtcacttcaaccatctaattattacgaagcagtatatataggttttttctaaaacatacttgcatttttttagctaacttcctagtgaccctgtcagtgcatgtcaggtaaaatggcacgtaacaaaatggttaatagattagttgtgggagaaaaaagcttcaaatggagaaaatcttatctcttaagtataaactacaccatctacctgacgtgatgatgcagatctacaaagtcaaaatgtgggaaatttattgtagcccatcaactccagtgaagaagacagtcaagggaagaagggacaaactcaagctatagcatcatattcataaacaaaaaagactttcaagtatatatagcatcttctctctagtgctacaagacatatagtatccactgaagcagcattttaagcttgtaaccccataggtggaaatgtataatttattaattttagtgggaatacaaatccaaataaagatcccctattccaggttgtataacattttcaaatttattgaaattctgagatgtactaatgggatgcatttaatattgcagttttgttcactgtatgagtcacaaaaaactaatagagtagttctcctttatccataggggatatgcttcaaaatcctcaggtggatgcctaaaactgcaggtagtacaaaaccctatatatagtatttatgaatttatttttctttcttcgcaatttcacggatagacttgctcttaccacagattttgagcaaccccagcatgcgatttttttcttgccttattaagttgggaaccttttcacataaagaaaacccttcacagtttttctttggcatatttgaactgccaccataactactcttgcactttggggccatgactaagtaaaactagggtgacttgaacacaagcactgcgataccatgacagtgtttctaagaacctagacaggtactgagtaatgggcgggtaacattgacagcatgaagacgctggacaaaggggtgattcagtcctgggtgagacagaggtgggatagcacaagatttcattatgctactcaaaacagcatgcaatttaaaatttatgaattgtttatttctggaatttttcatttaatattttctgactgtggttgactgccagtaattgaagccaaggagagcaaaaccatggatgagggagggagggagggagggagggagggattgctgtaattaaacactcttttaggtacataggcaacctatttaacataactatttaaaaaatgccacttaaagtgttctttatatccaaataatggagcaagtttatgattcagctaatatctaggttacagttaatgacagccatcaatgcattcattcattgatcatgaatttattatataacaaatatgtaccaaatatctggatatgccaaatattaagagaagatgttacaggctcaattgtgtcccatgaaatccatgttgaagccctatgccccacctactacatcggaatgtgcccatatttggagatagagcctataaatagaccattaagttacaatgagtctattagggttactctagtccaatatgatgggtatccttatgagaagaggaaatttggacacagcaaaacaccagggatatgtgcaacacagaggagagaccacgtgaggatacaggaacaaggcattcatctgcaatccaaggagagaggcctcacaagagaccaatccttgccagtaccttggtcttgaacttctggcccccagaatggtgagaaagtgtttgtattgtttaagccaccagtccatgttattttttaatgatagccctcacaaaggagtaatacaaaagacaattaagatagatggattctttttcaagaaatacttggctaaatgtctgtcgaataataataccaacccgttaaagaattgcaaatgttaaacaagagtatgtatgggaaagtattattaatttgaaacaagttatttaagagttggtcgttgtttacaatttgcttgatcatggttcttacatcaaatctaagaactgccaagggtcatctattttactgtattcactgtagaaaggcacccattaaatctttacgaataaatgtttagtcttcaagtatattctttaaaggtttccaacacaagacagcatgaacacatatcctttagtaacatattctattgcttaaacctatcttactcttagaaaatactcaatgaattgaatctaagtcacttctgtagcaaggcaggcatagtgctttccactgatctcagtgtaagcggaaaagtgaattagaaattacttgctcatacgctgtaaacatctgcccatacatttttgtgatgccatatgcacaagtataaatagataatacacgaagtgctttaaatttatggatttacctatttattgcttagcaatattggccttaatttgaattacaaagaatgaagcaaagcaattggaagactatatccctcagctctggaatcactcaaagatgctggttcctatcattgcctgaatggctataacaaaattgttagacaagtgtaagaaattggataaaatggggctaatacatatattttttaaagaaccactgtattaggattagaaacctcttctctagagaaaaaaaaaatatgtaacttcaactctgtttctctgagtttctatttacgtataggaatcccttgagcttttagcaataatgcatatttttatagagctaaacattctacacataaatgtaaaaccaatgaattacaaagtctcacaaaatggtaaaagaagttaatttttatttatattctcattttgtctcagcagtaagtgaagctaaaggtcagctcacttcgtctaacattttcatggactaaatcacaactccattatcgtccatgctcagatccacaacggggaggattttttcctcccatttaattcacatgtcatattgttgtacgtgccaaggacatttctcatctgaattcctttgtttggttgagttgctatttcaattcaaaagtgaaaaatggctactaaaagaacatttggataaaggtaactgaggaaaatctgacaagcctgggaggtaaatcttaagtatggtgacccttgaatttactggagccagggatagaatatgaaacctaaactgtgcccatcagtattggcgttaagagatagagtgttcccaggcgtatatccactaaggcggaaacaattatgtgccatggaccacacaatgcatcagcaacggggctttatgaaagagggaggcagaaaacaacccatcttattttattgcaggttaagaccctataatacacttctctgctaaatgaattttatgtgtaatgagccctctgaaaatcccttatttcttgatttttctcttactttatcaacaactatgcagttaaaacgtataagcaacttactcttactgatgttgaaatggaaatcacatcaaaaaccattgaaaaaaacaaaaatccattatgaggcagaaatgtggcagagtcctactgaatagtgtttagccaagggtatggcttggttctcagttttacacatttctacaaactgaactgaagcaccatactataaaatggtgtaccttatatcttcactgtataacatatggtacagggcggataaacctattttgatgagttatgaaacaactactggaagttttttcaaaagtataattcttacttctatttaaatgatcctgtaataatctcctgtctgaactcaaggaatttttagctgtcacttccaaaggggcaggttacagatgaggaaactgacagataggttaagtaacttgtctgaggtcacagaagccacagtactgagtgtctgggatttgacctcagatccatttggctacaagttcatgctcgttcataatggtattcattcagtagggcattcattataaaagatatgccttctaatttgtgctacacaacctacagtgagatatccagatgccgaatccctttggagtcttttcatattttgttttagcagaagtttgactagatttaacatttaatctaatctgcttcacaaggatgtgaagcttaatgttataatttgattcaaaaacatttgacactgtaactctgtatttgtttaatcataaaacgtcagcaaatacttgcacttccagattaagaacatgtggcctttgcaggacttatttttaaaaggtaagtatgactgatttgttcattaaattctgcctttgcaattgtgctgaaagtgtagtgagattttaacacgaagaagcatgttcttctctacgctatttcagtcagtttcctatattatttatttgtgtgagtatacaaagtgctaatgaataaatctggaaaagccttttgttgttgtcactgctgttattctttgcaggatattatttaatgtcttttttttttttttttggcagcttaataaactctgtactctccagctcccaccagtctgttcaattgggataccagaaaataaagagcaggagttctaaggagcattccagcgtaacagtgttccttccagcattcatcacattcccaggcattccttggtagcttgaggtttcctcttccttatcgttttatacctcgcagactctgagctccttgaggtgggctccttacctttgaggttaatgtcttgcacaaatatcccaaaactgaatactactactgtcgttatcaataggtggctttccccacccaacttttgtcttagaaccatcttttttggatctttcaatctgctaatcattacataaagtataaacttcctgcattcccacttcagttctactgttgcccaactttgtaatatctgtgaacaaactcaatcttgctgtgctttagttttctcaccagtgaaatagagataatagtacagactctcctagacaggtaactgctagggtcagatagatcaataaatgtgaaagtgctcttaaatctgtgatgaattattgagatgcttgtgatagtaaggatttagagctcagtcgataaaaaaatcagcctttattccagatgtgataaatctggagcatgatagaattttaatatagaacacagtgaaacattttagaaggacaattaatgataattttttttgcatttttttctatacttgataaagcttatgttttatacaagaattgaaaatttttacctttacaattttaaacaacagggccatattccaataggtatcctttttttctttttctttgagacagagtctttctctgtcccctaggctggagagcagtggcgcgatctcggctcactgcaacctccaccacccaagttcaagggattcttgtgcctcagtttcccaagtagctgggattacaggtgtgagacaccacacctggctcttttttgtattttagtagagatggggtttcaccatgttggctggtctcatctcaaactcctgacctcaagtgatctgcccgcctcggcctcgcaaagtgctgggattgcaggcgtgagccactgagcacgggctccaaaaggtatcttatttgaaagcaagtgcatagaagataaatatccctctatgtctcatgccaactcttgacatcacaacttttcatccacaagaaatcacaaattctaacgtacatacctaataaaatgcataagataatgtaggtgtaacagaataggtagtaatggggactgtggctaaatgaagagcctgtgctagagaaaacagggcaacttgactcctgctctggttactatgtagaaaaacagactaaggatcatcagatcatttgctttctctagagaggttagaaattcttagttcatgtcacatttttttcaatttcaaacaatggtagctaataaactactattaaataccatagggactaaatagaactttatctaaatacatctgtaattttagatgcaatagaccaattcctagaaagacacaaatgattcgagctgactccaaaacggaaaatctggaaaaatgtaatgttgaaattccaattaaaaatggacatttttatgtgtattaaatacataaaaatttaattttaaaatttcccatttgcaaattccagttatgaagccagttaccaagcctgcataatcaggtacttaaacctagcaagcatattacaagaaaggaaaataacaggccaatcactttcatggacgtaaaggaaaaactatgaatcaaagaaaatctagcaatacacaaaaaagattatacgtcttatccaggtttagtttattacaggaagaaaggcttttttagcattagaaaactaagtcatgtgatttgacatatagcagaataaagaagaaaaatacgaccatctcaaatgattctggaaaaatatatgataaaatttggcatccggtagtgataaaacctcttagaatattaagaacagaaggtatctacaacaaacctacaggaaagatcatacttaatgattatttattaaagttcttccctctgagacttaaaatgagaaataaatatccacaatactcccattgtactagagtatttatacagtacaatatgtcagggaaaattaatgacatgaaaaataattggaaagggagaaagaaaactgtcattactcaaaaacaacctatatatgtacatctgaataatactacagataatgtattcaaattattaagtaaatgtagcatggtacctggatacaagaccaagaaaaaaaatcaactgtatttctttatatcagcacaaatagaaaatgaaatttcaaaaatatattcataacagcaaaaatataaaaacccaagaaataaatctcagagaaagtttaagagcctttactttaaaaactataaaacattattgagagaaaataaagacctaactaaatgaaaggattgaaagactttacataataaaaatgttgattctgtacaagttgatccagagaatagatgaaatccaattaaaaccacagcagattctttttgggggcagggttcacaagctgttcttaaaattcatatggagatcgaaatggccaaaagcagtcaagataatctttaaaaaggaagaaaataaaatggcttttactgaccaactgaccaaaacaaacttaatgtgactaaactctagacaggcttttatttgactataggctcctgacctctcttttcttagagcgcttactttagggaaacttgcaaccaaaaacatattctctgcctctttgagatgtaaatcttctacaatccgggaatatctttctcaaggacctaggagccatctctttgaaatgtaattgttaatgatagcacgcctatctcccagtctctgtgggacagtaggagcctaacttcattaagtgccaattaacaatcacagattgcctaatcaccatcctaaccccctaatatcttccagtatttttctactagctctcctcagtgcttaaattctctcctgtctttctttcagtagaaatgatttccatctctctctcctatggcaatagtcttgatccataattcagtagtcttgaataaagtctttcttgcctgtttgtctggtgcattttttcttttacaatattaccagatacaggctgggcctggtagctcacgcctgcaatcccaacacttcggcaggccgaggctggcagatcacctgaggtcaggagttcaagaccaacctgaccaacatggtgaaaccctgtctctactcaaaatacaaaaaaaattagccaggcatgatggtgggcacctgcaaacccagctattcaggaggttgaggcaggagaattgcttgaaccagggaggcggatgttgcattgagctgagatcttgccactgcactccagcctgggtagaaacagcgaaactccatctcaaaaaaatattaccatatattaaaacttgtcataatgctatagtaattaaaacaatgtggaattagcatgaggacaggcaagtagagaaataaaactgattagagtccataaactgatccatgcacgtataggcattttatttctaatattttcgtcaaagatgacaccacagaatattgaggaaaggatggtcttattgaaaatctttgcaataagaccatcttttcctcaatattctacagtgccaacttgttgtttcagttggatctatatgggaaaaaatggacattcatcccttcctcatacctgtaataataggtggattgtaatacgaaaggtaaaacaaacagttcctatatagcaacccaggaccatagcttcagaattttaaagtagagagttttatttttaaactgaggacaaaagtacactaaacataacagaaaatattgaagtgaactatgttaaatttaaacttctgtttatgaagagatatatcattacggagtgaaaaggcaaggtacccattcaaaaagaaaaatgtaatataaacagcaaagaatacccagaatatatatattttaaactaaaataaatcagtaagagaaatatagaaaatccagtagaaaaacaggcatttcagagaagagttcatttaaatggccaataacaactgaaatagtattccgcctcactggtcatcagtatatacaaatgaaaaatgagagatgacattataaagtcaccagaaaggctcaaattaaaaagtttaacaaacaagtattcaagaagatatgaagcagtttgtactttcatttactactggtgagaatatgaatttatacaactttggaaaaccctttgttaatatcttgaaagctaaatatgcatatacccaatgattaagaaatgctattcttaggtaaatacctaatacaaaagtttacatatatacacaaaaatatacgtacaatttatgttgatagatgaattatttgtaatgcttccgaactggaaacaaccccaattttctgaacagaatatgtaaaatgtggtatattcatacaaagtaattctatccagcgatgaaaattaataaagtaatgctatatgcaacatagtgaatctcacaaatatagtatccagtgaaaaaagccagttaaaaaactgcatatataaaagtttcatttacatcaagttaaaaatatagcaagactaacctgcagcattataactcaagatacatgttacctttgaggagatgggaagagtttatgataccatagggcttgatggaggtttcctggttgctggtaacatactatctttttctggatgtggaatcatagtatgttacttctgtaataagtctttaagctataattataacttatgtcctttgcttgatacttcaatttaaaaagtaccataaagtttgcatttttttttcagaaccatcaacagataaacagataacaggttatatatacataatgcaatgttatttggccataaaaaggaatgaaatatagctatttgcaacaacataaatggaactggaggtcattatgttaaataagcaggcacagaaagacaaataccacatgttctcattcacatgtgggagctaaaaaattggatctcatagagctagagattagaatgatagatactggagactgggaagagtgtgtggatggaatgaagagaggttgtttaatgggtacatacgcttagatagaaggaataagttctaatgttcgatagcagagtaggaagactatataattatatacaacagtgtaacaaaatatcacatgtactctataagtatgtacaaatattatgtatcaataaacttaaaaattttttgtaaatgtattaacacttgcattcataaagaatattattggccgggtggccgggcgtggtggctcacgcctgtaatcccagcactttgggaggccgaggctggcggatcacgaggtcaggagatcaagaccaacctggctaacacagtgaaacccatctctacagaaaatacaaaaaattagccaggcgtggtggcaggcgcctgcagtcccagctactcgggagtctgaggtaggagaatggcatgaacccgggaggcagagcttacagtgagccgagatcgcgccactgcactccagcctgggtgacagagcaggactccgtctcaaaaaaaaaaaaaaaaaaaaaaaaaaaaaaagaatattattgttccagcatacttgcttatatttcccctgtaattttgtatggtgggtattatgatcactgttatctttgagtttcatttgataatttttatcatgagagaatttattgttcaactcataaattataaagtcagaatagaaaacagattgagtaatccagacattgtgttctttcaaatctacctaacaccctattggccaaatgtattacaacagaccgtgtattaacataaattgaaatctagcgttaactgtatacttacagcacattggctttggatgttcaaatttcattagaatattcaacatttatttatacttgatacaatgtgcagttgaaaaaacaatgcacatatcaaagctgatcaaaacatactcaaaagttttctaataactgaatcatgtgccattttatatttaagtaaataaaataaaaaatccagttcctcaagcataccagtcacaattcaagtgctcaaaatagccaaaggtgtatagcaacttccttactgaacagtgtcgttctagaaaagaaaaaaattttatatactaatgcaatcgagtgtgacaggtgttaatatatatatactgcttatataaactatatacatatataaaccattctcttctagaacagtgttgttctagaagagaaaaatatttatgtactaatgcaattgagtgggacaggtgctaaaataaataaatatatatgtttatattatatatatttgtacttgtaaatttaactcattcatgcaaatgctatatctattcatatatatatgaatagatattgcattttatacagatagatagtatttgcatgaatgagttaaatttacaggtacgaatacattactgtgttacataggtttctgtattcccccgttgctgattagtaaaccaaaactgaaaaaaatcacataattttcacaaggccacatagcaaatttctactatgaatttgagagattgggagaaatctcaggttgagttgtcacacatctgaataccagtgtcagccttgccacctgcaagctatatgaacttggatttaacttcattatgcattggctttctcatttgtgatatagggttggcattacatacaaagcatgtaaaactcctgaaaaataataatctaataattataattattgcttcttgggcaacaaatgttgatgcttagctttgtggattatttccatcacatttaaagttttttttaaatgcatttaattcaccaaatataaaattaggaactagagcgaaacatcaaaatgtttcaaccatattcctcttcataaataacttctatttcttaatttgatagggtctaacattctataaaattttctttctcatactatcccgaagatatgtactataaaaatttcagttacctaactgacatttaggtgatgagagaaaaatctgactttatcgtctttctgaacaactacctttcacagtatagcattttctttccaagtggctttgttattttaacattctctttgtaactgagatatagcacattccctttgtaacctgtgtgatactcatgttacacaagttaaaactattaacgacactaacagcaatgtccaaagagatgttaccattaaatgtctgtcattcttattgtctacttatccagatttgtcacctttaaaaattatcactgttggtcaaaataattggcagaatgtagtatttgacttctttatattttgccattatattcagattgttttttcttatgaaagtaattttgagaatcatgctttttaaagctgaagttctctacagaatgagggagaattatgcttctactagataagattgggcagtatttccttttattttcttgcactccacctgtattggaagggacattggaggctatcaagtctaacttcccactcagtatgtcacctcttttaaaacatacttgaacatgagattccagtttgtgttaaatattattaatgaagaacagctcaccactttccacagctcttatcgcattgtaagaatgctctgggctgatgatgataataatagtaactaatattattattgcttactatatttcagtgatttttaaatgctttagcttctcaactacccttttaccctttacagatatctgataatgtaggttctaatacaatcttcatattaaagatggggaaactaaagccaaggatggttaagtgacttgcccaaaggtatactgtagataaggaacagagcaggaagggtctatttctagagtttctcctcttaattaccttacaacaaaaagctctcccttttaagtcaaaaaaatctttcttggaattatatccaaccgtctgttcataggttcattcagttatcttacaagaattactgattacttgtatctgacaatgcaggcaagaatgtgtaagacacatctcatgtaatttagattctaataaaagagtaaagcacattaatattaactgcaaaagtatatgatcggtgcccaaacagacacaattagggtacagacatggcacaaagagggagtagtcatcactaggtagagtggccaatttcatggaggaaaacttgaaatgagttttctatacatagatgaaattatcaaagcagatcttatgaagcagagtcgtctgtttaaacccggtggtatgtgcaaagaggtcgtaacatacagggtatcagaaacagcttgtatgaatcaaatgcaggttgagggacataaagcagataacatgagacaagtctatagagactggtaggagtcaggtaatcaaataccttgtaggccaaagtatcagaatctggaaagtgactcaggattttaagcaaaggagaacgattaaacaggctcttgggaacccacactgacttcaatgtggagattggatggaagagcggtaagactgaaggcaaggactttgggggcttatgatatggcctataccttgagaaatgttgacaagaacaaagatgaaataataaatacaagataaggttgagaaatattttgacattgcatgcaaagggctcataagggaaaggacagggatgaatttggggatgactctaggtttctggtacaggtgtcatgataagtgccagtgcaatgacaaaaataagaaattcagtaaggaaagcaggtttaaaggaaggcaatgtacagtgaggtaagtttcatcttgttgagtttgaagtgttgtttggacttcaaggatgtgttcagaagataattagaagaaaatggactcaggaaagatctgggcagaagacatccagagttaccaacttctgtctgcttctgatattatgacattttgaaaaaccatagagaaagtgccttcctttttcaccatcacaatagtgttcatgtgccatttccctatgattagttattttttaattaaataatcgcccactctacaaatattcttcacaggatgctgccatctgagaaaatcctgctaagatagagtaccaatcgtgggcgtaaaatacagtgtattcaaatcagcatagagtataattattagttcatgtaatctagacactatatcacagtctgtgattgcattaactaagaatctgtatcatccttaatatcaagcttgtttcaaagtaagcatgtgcactctatctcatatgtgcttatgtttatgtatatgtatgtatatacatatatatacatatgcacaaagatgtacgtatgtatatatatagaaacataaagagatgtatataaatttaactatatacacatttatacatatatttttatatagacaaaattacatgtatttttacacacttacatttatatatatttacatttatatctatagatgggaagtcagaccctttgtatctcaaactaattcaactgatttatactacttgcatttttaaaaagcagcaacatttcgaactataaacatgagttttctgacttaaaacaataggatgtaacatttgtatatgatattctaactcctcaggacatagctataaaccttctaagttaatatgggagcagaaatattccattaaccactcctacaggggcacactttacacagagccccagctaaatcctcaaatggcttccttccccagaattttcagcacgtaaatcagatactagaaaggaatatattaaaacacagactcacccacgaacactcatagagaaagatagactcaccttaccaataaacagtatcacgcagaggctttgctaaaaggttcaggaaaatcagaatacctcaaattcattccattccattggatcagccaatttaataagtctaacaaaataatttgtcttaatactaccacaaagtatttctacaaattgtttaatgtcatctgatataaagttggtttacatgactcaattttagcgaatgtagcttagttcttagaaaactatctcatctgcaaaaattattccttcaggcaataaatatgtttattaactgcatgagataagtgagaaaccataccagtgagcatggcctcatgtttaataatctgatccaaaattgtgttttccaggttttccttcttgaaaatagaatacttgttgtgacggttaatattatgtgtcaacttcatggaattgagggatgcctagatcactgatgaagtattgtttcttccgggtgtgtctgtgagagtgtagccaaagaaggctgacatgtggaccagtggactgggagaggaaggcccaccctcaatgtgggtgggcaccacccaatcagctgccagttagactagaacaaagccaggagaacagggataaagtagcttgcttggtaagtttactcactctcttcctgtgccctgcggggcagttggcttcctctcctcctgccctcggacatcagactccaggactccaggttctccagtctttggactgggggacttacaccagtgatttcccaggggctctaaggcctttggcctcacactgagagctgcactgtcagcttctctggtcttgaggcttttggacttggactgcaccaggctactaggttctctcttctcccagcttgcagatggcgtatcatgggacttcaccttgtaatcatgtgagccaattctccatgataaactcctaaatgtatattttatatacacatatatacatctatctatccatccatccatccatccagtgggttctgtccttctagagaaccttaatacactctgtctttatccattctttataattatttttattaggaaaatcaaaatacgatatgatagtcttgctatgttgcccaggctaatctttgaacttctgggctcaagcaatattctctccccagccttccaaagtgctgggattacaggtgtgagccactgtacctagcctcattcttttcatatacttttaattctccaaaatattaggcagtaacttcaatattaaagtattttaacaaaataattcaaatgccttttatatggcagaaattctcctggttctatgaccacacagaccttcaatacatctatagttggctctcaacttttaacttgtacagaataacatacctaaaaatagggttttaatggttttgctttttctttggaagacattttcattagagcatcttctataagctatgggcttaaccatgtttctccttctttctttattagaaacagttatctcccaagaacaaaaggctttctttatggtctttttatagtcttttttcatgcaagtttttataaaccacgctctcttgatttaccatttatccatcctagaaactctacccacctccaccaatctcacttatgatggcagcagcagcctgtctggagcggccactgcaaagatgccagctgcagcaagggaggcgtggccagggctgtgcactgtgtggagccaccaagggccaggaacaagcaggagcgctgctccctactgagttggcagggtgggagccccatgcttccaggtgcagctgcagccacccagccacagctccggacctgggcattcctgcgctcttgggggcctgggaagcccccctgcctccacatactaagaagtgcctgctcccactccctggcatctcctcgctccccgcactggctcctgggagaagcaaagttgcggccaagaccaggtgttgtcgcaacctgactggttatgtgtgtgctcgggacagtgctggcatgccagccccctgctgccttgcgcccgtctggactttgggcactgatgagcatgggagagaggctgagtggggactgaggatggttcggtgtgggcctgcaggtaccccttggtataaactgcctaggctacatggatggcatgttgatggtggcaggaggcagactggctcctgggcagaaaggagcagatccacagagaaacccctccttcaagccaagaatggcctgaagcctgggggctgggctgccagttctgggtggagtttgtggcccagaatgagaacttatggtgctttttctgggcctatccatggatgtccatggaccaattagaatgtacctcctcccttccgagcccataaaaaccccagactcagacaaacttagacattgggactaccagccgcaggaaggagctacctactttgtgtctccttgactcttcaggatgacctgcctgcataaaggagccacccaccatgggtctcctctctactcacagctgcacactccctgggacgacctgcctgtggaaaggagctacccaccgtggtatcctgagagctgttctctcgctcaatgaagctcctctgcaccttgctcaccctccagttgtccatgtacctcattcttcctggacatgggacaagaactcaggacttgctgaatggcaggacaaaaagagctgtaacacaaacagggctgaaacatgccccccactcaccatgctatgggcaatgagaaacagagaagagctgtggccttttgcagagcccagaccttggggctcctcaagccagggttgtggcatgctgtaacatgctccttggggctctgtggttcctggtgtctctgagctttcaggtgccaccgcgatcccctgtccagacattggtgcctgcagcagaagctacttgtggtacatctggtccagccacagcctcacatggagctgccaccagtactggtgcctgtagctgccttccgctgcagctggcatgcctgtctgtgcacagtggccaggcctcatgctcgcttgctcacatacctcttactgctctgtgcctggcttgcccttggcaggcatggggatccgggccagtagtgcaagccaagcacagcctgccaggctgagtgggtgcaaggagcccagcgggcacaagcaaaacccagacagaggtgctgccggccacagaggtttctggctggcaaagtgacacccaaggatcccatgacacttacatgcacactttatccattttcctccaatgtatgatttagatcttagcttaaagaaaactttcctcaggaatcatctgttgcgttcaaagttcagtctaagtcagagtaatttcctgtcacaaaagcttattttttgcctttataaataagttgcatccattctttaacatttgctcatttttaaaaatactttattaatgtctatttttatactggattgcatgtaccaagagcgcagttcccatgcctacctgcctatcatagtgaccatggatgacaaggaattagcattctactacaaagagggagactgagatatagtcaccattgttccagggttccaaggaaggcagtaggctctcaaattacccatcgcaaccagggtagatagtgacaaattcttttttttaactgtcttacctggttacccaacacaatccctgggacatagtaagaacataacgagtacttgttgaaaaaaattcaaatgggatgtggaatgcttagaaagagatgtggtaatgacctctaaaactgaagactatataaatgaccaattttagttataaaatttagtttataaaaatatttctcaatcaaataagttaactggcatcactgcctatgaaacagactctctacgcactgacatcctggaagcctctaaagttaaggacaagactctaatctgcagtaacattgctgagggacaagctgaacctttgagagaaagaatctaattatcggagagcacacttttcagaatattacacttcataagctatgtcatctttcagaaactctaagcatatattctgacctgtctttggttttcttcaaaccttttccaaagaagactctaaaggtattttaaagttagagaaatcctaaaatatcatcataatagaatttacagaataaatcaatacatgcagatatatcctattggaagtatttttagagttctaactcagggtgttaagtatgcatctctcttccttattggactaaatggggacttcccttcctactttcccccatctgtacctctttaccaaagacagctggctatcctttttgagcctctggatggcatttcaacagaattttagtgcaatggatgaaggaattgtggtgatgagggatgccagggcgaaggaagagaaggcgtgagatgggcactcaacactaataggttttgaggaataagttaaggatagccagactctgctctaataaaaagcctgctaagatccttctctgagtcctgatgattgtttttcttttaggggatccaaatacctgtttctctttcctgtaattcttctaattacgtctaccagaatccctctcagtccagtattaaacatattaaagtccacagtctctgaagctaccctagaattataatatacccagggtatttgtgttaaatttttttatgtttttatactttatcaatcttttaatactttatgatttctccttactcctccttctgtaccatcttctcgtcctcttcttcttgcttttaaaaagtaaactaggtaagacaagattatatcacttgcaaagaacctaagaatcatctctgtttcaaagtcaaatggaagcagagcattccacgacaattccagccaatagttaaataaagtatagaactcaagcatggattcttttgggactgaaggaactgatgggatggaatcaaagaaaagttatagcaagggctttctctccacttgattccttttaatgctgcccttttagatactagtctagattatcttaaagtcacatgacactacagagctatatagaggcaaaatgagaacatcaaaagaggaaagaagattgaagacaaaagaggaggctggaaggcagtagccattaaaggggtatgcaatcatggacaaatgcagatagagtttaagcaaattagggataatcagtacatttaccgatatttagtagatgtctttgggccaaagaaataaaggcagaaaataaggtgaaaatgaaagcaagtagaaaacaaatacagaagagtataggcccaccatacaaccatctgtgagttctacggactgtttttcaagatgccttaaccacacaagcatcaccttggatgaattatattgaaaagctattcacactgggtcagctaatgatgaaatgggtgctttcaattgttattttaaatggaaatactccatgccttagaaaaatgtctgcatttaaattttttttaaccagtaacctcccttcaacccctgcttcccagccttatttaatattaattgaaattttctggtaaagtattagattttacccatccgcagttagttactattgtatcagaattatggaattctttaaatcacagcacttcagctgattatgagtgtgtgtatattgtacacatattgtattctaagtattttaatatataaattgcattctaaatttttaaaatacttttcaagttatagttcttttaaaggacatatttagtttactaagcaaaataatctgaccttaagttgttcttccaaagcagcagttgcgtgatctccactagattcatcaactaccaccaccatgtgagtgagagaattgaccctgacttgttcttgttctagatcttcttgaagcacctgaaagataaaatgttttaaaggaaattaaaatgatattcttacatgtgtgttgaaatgatttgctctcaaatggtgaaatttatttctgctacatctcaggtactcccattttttattaacctaaaaccattccaagccaattttctgctatgacgctcagcaaaatttatatgttctattgttaatttaactggaaagtatctagagaagacaaatgttaagaaaggtacagcaggatgttctccttctcatcccaccccctttctccctttcaaggacttttttcctacaactatcagcacttctggcattttcaggctcttcttctctactgaacttctccattaccataaaaataaaacaaactcttgatccaacaaaccggtcctcctactgtcctattatgtgttcctcttcactgaaaaaaaaaaaaacaaatgtatcctatagttactgtgcctacatatttatcctactattcactttgcccactaacccattgaaatatcttttgtaaaggacaccatcaactttcatgttcctaaattcaataaccatttgttatagcgtcttacttgacatgttgattactaacctaattggccactccctcattcttgacaccttctcttgattaccctcctacctatgtgctactttttttattttttttttctattttggagacggattctcactgtgtcacccagggtggaatgccaatggcatgatctcggctcactgcaaactccacctaccgggttcaagggattctcctgcctcagcctcccgagtagctgagattacaggtgcacaccaccacgcccagctaattttttgtattttcagttgagacgggatttcaccacgttggccaggctgctctcaaactcctgacctcaggtaatctacccacctcagcctcccaaagtgctgagattacaaacgtgagccactgtgcctggcctatacactactttttagctcctttactcgttttttcccttccgctcaaactacaaatcagatgtcagtccgatttataaaaaccaatagatttctatcatactaagaaagaaaatttaacttctctacctgaaattcttatatgatctagcacctgactacctcaccagtctaattgtataccattctcgccctcacagtgtttcagaatgacttgctttgtctctcttccaaaaatgtgtcaagctgttccctctaccaggattgcttttcttccagatgtttaaatcatttctttatcattcaggactcaatgtaagtgtcacctacctagagcagcttttcatgagcaaactatccaatgttgctccctagtaattcaccatttctgtcatttttttaatcatagtattgtcactactcaataatttcttatgtatcagcttagtccttttgtctctacttactataataggcagtccactagaacagagatgccctctgtccttctcactatgtattacaagcaaataaagatcaataaacatttgtcagataaatggtaccatgtgggggtttggggaaaacatgcacagatgagtttgttccttcctgattgcacaaagattacaatataataggaagaattagtgatttttggtgtaatcacaattacactaacctcaacagaaaataaccacttggtctcaactgaaccctaggataaaaccagaataattcaaatactgcctttctaacttacaaatgtggctctgaaaaaatcatttccccctattaagtgaggctgtcacaaaacagtatttccaatctttttaaaaacatgatgtacaattattttgtaatgatgaacaggggtaaacacaggaataaattaggggtaaacaaaggaggctgctctagaaccaaggtatgttgcctgggtgctccagatcccataagaccttaccctgttacactatttattattgggatttctctgaatagctatttgagacttctaggcaactactttgtttcttagaacattttgttacataacacaagagtggagaaacaagtttgggacatttcccgttactttctggcaaacgtgctgtccctacttgcaaaacaacagtgcttagcacctatcagtctagctcttaggtattcaaactctatggcaggtggaagggaacttattaggatggctgaatcacaatctcaaatgcatgagcatttttatcctaggcttcttattttcgaagcctcaacattttagaacactataaaatcacttctttttacttcgtctctctagattttcatactacattttcaagtgaagcaatttagaataaaatgactatgcatctattttgtgtgtgcaatctatactgcctatcatgcctttgacattccagagcttataatggttaataaaactctttttgccatgaggccaaaaatggaaacattaaaattcagagttgtccttgacagtcatgttgagtctgtgttttctgagttatataagacaggactgggaacattttgaaggtgtcagccgggaatgtttcaaataataattaaaatgataatttggtggccagtgtatcataagttggttttctgaatttagtcaattcttttctgtccttcaatgagtatatataattacatatattacaaaattacaagtaaataatgccagttttcatttttacatgtaaattgctttttcacaattttaatatattttacttaagaagtgtaagaaaaacattggatccatggaatgaatccaactcttattgagtcttttaaagtctatgtgatcaaacgtactatattctccattacttagttgttctgattttgtttcgttcatctatttgttttataattggaaatggcattcttgccatattgatcaagggtttatattttatgcttggcagaagtgctaacgtaaagtaccactaaagagagttgtgagatgatagcattaaaatctaacacaagaaccctctggacttacggtgagtacaaggaaataaaggagtggggaaaggctctctacagtgactaagaacgttgaagagtccagagtgctggagtagatttgcataaggtacatttgatttaatgttatttccagtatctcttctcctctatgactttttaaaattgtatttcttctttctcagctaattaggaattaaactaaaaaaggttaaactgacttttttgagcacactaaatagctgtaagacaaaagctatggtaaaacagtaagcacgtctcctattttctcagacttcaaatgcgaaataaatattagtgaatataactgtattagctaatctccttaatatcagcaaaatacagattatgaactatgcaacgttcagggtttacttttacactgattcttacaagtagcagaaacgccagacataaaaagctggagttaaaaagttcaattgttctgccaaactaggaatccatgaataaaggccttgatcattggggtaaagaatgcctgcctgtttctccagttggaaagaaatgaattctcaagagtatttaaaaaaaataatatgctaaagtgttgtaaggctatatttaattacaattttaaatactgacttcttatggatttcaatttgtcatagatgaatttatacaacggagatttatattggatttgctaattaagcctgaaatatgagccaaatagtttccaaatatagatgcatccctagagaagtacacaaaaatgtttgtctgtcagaaaataataccttcaaattaaaatattgtaatataatattgttaaaatgttttcctttattaaaagcttccagattgtacatacacatacacatatatacacacatactaggtactttattatgcatttattttcattattttattaaaggaatgcttttgtaacacttaccagatttcaaacatctatcatgttcctagttaaatttcattaccattattagatacaaatgttaccaatgtttgttgtcaaatgtcaaataatgtatttttttctttatgacaagagaaaaggccaacagtgagatgtaacattaagaatgcctagattggacaaacagtttttgttatacctctgtgaataattgtatttcttctaaataagtctctagttaaagggcttaacaaaatttgttactcccttagtacatgttcccaattttattatttaaacctgacttttcttgtacttcttttaaatgccatcagtgatactgaattcttctggctcttgtccatgtcaagttggttttcaaaagtggcttagaaaaaccactggagagccacttcagtgtttattctagatctatgctattttaccctttcttagaacacatgtaaaataatacttaggaaataaagacatggaattatgtaaggctagggaaatttttgatttgatgtttaaaggtgaagagcaataattaatcgaaaggcagtataatagaaaacaaaaacaaggatgggtatcctgtaaattcgatgggagaagcttttgttttacttgtctatttcttttggccatagcatagactcagctatggaaagaacaggaaaagaacagctgttacctatatgtaaagttttttttttttttaactactcctccgacttcattgaatacccaacagctaattgccggtacttgcaggtcacacacacacaaacacgcacacgcacacacacacacacacacacacacaaaacacacccctagaaacaacacagaacgctgttcatcatgaattggaaggcaatctattgtctccaaaaatgactttaaaattaatatatttagatgtttaattacaaatattcagtagtttgtagtttatctcaataaatgcacacataaggaaagactaacgagaaaaaaattgtagcaaacataaaatttgcaaaggacattaagaattcagaaggttctaggaatagagttgagtctaacatccaggaaagaagtatcttaaaaaagctgtctcatgaacaaaaaaatccctagatactaatgatcatgttaattcaagacatctggacaggaattgactttttttcaaataaaaacttcaagtacagatcagaaagtgttaggatttcttgggaaatgatggggtggtaggtaatttatttttttcactcttttcctctatgccccattccttctaccacctctacactgggctaggctctatatcccttgctggcctgaatgatatgatctggaaaggactttcgattttatttgcagtgaaatattcactttgctaagcctggctggtcacagtattgtctagctttccatgaagatctatttacggtatataactttgttataaatttgctgaatattttaaataatcttcctcaacaggctaccctagaaaagcttttgatattcacttacttaaatgtgattgaatatctttattagttcttatatcagaacacactgattttatctttttgttagaaatgaatgtttatgtttctgccaactcctaagctaccaaatgggggttctgaaagactgtttcaatggagagatttgaaaggctatacaagcacactaaatgcttctcaatagcctgaaggggactcaataaatacgaaaagaaactgttttaaaaataaagtagacaattaatgtactcctacatatggaaaaggacataggatgaaatagattgaccaaaacttgtgcatgactatgaggagacagtaaaactgtagtcaaaagtgtagcatctgaaatcagattttctatgtgtaattcctggaagcatcaataaccaatcacgtgactttgagaaagtcatcaaccacaccaagcctcagcttcctaatttgtaaaactaagataataaaactgcctatttctttatgtggttaagaagattgaataaggtaaaactgttttgcattttgcctggaaaacaatataaattccaaaaatattagcatctaattagttgaaagaattcatatttagccatatttatatcaaagttttgaaactaaactgcaatgacctaacctaatactaatctattttaccctcatctaatacattctgactatcatcctttctaatagacatcataagtgcaggaagagaatgtgatttttgaaaagtcatgaaaacaagtgaagttacagcaaagttttaaggtctggagaaatatacagtaagtgttaaatccttaaataatacctgaacttccaatttatttacactacattaataaaagtaggttcaaactacctcatctgatggttatcacagaaaaatttgcatgggcagacatatgtcatggagtgaggacagtccctaatcacgaaatggtagccctcaattctcttgcctttcctactctttctacaatccatgcatgcacccacccatacattctgcatatagttacagaattaaaatcagattaaaaaccaataacattgaataaataattataaaatgcctttactgaaaataattattgaaaaagaaaagaagattattgggagagagttggggtggaaagtttcaggcagagcacagaggaaatgctatgcattgtgctgctaacagaatatagttgtgaaattcagttccaatgattatcctcctgctcagacggtattgccattcttatcataagcctatattcctgtttcccttatagtctctttttcctctattttaaagaactacaggagtaatggtgatgaattatttcattaagcattttgattctgagtatttaatgtgtagctaccactactgcttactctatgtttgaagactcatatgcacacagtctctgtaccttctatctagacattcccaatcctgggaatccaaatgccacaacatcttcaaatctctttgtcacttctctgcaactgctctagtctctaggatctcaggtggagtcaagcttcactggaatctcaaaatggagagaaatggtctcaaaggcagacaggtcaaagttaaaatcagaatctaccaattaatactgaagttaccttgaacaactccttaaactctttgaacacatctatttgtctgtaaaatcaagtattaatatccttccaggccagacacttacagaacattctattctaccaccacagaatgtacattattctcatctgcacgtggatcattatcaaaaattgaaaatgtgctaggccacaaggtggttcttaacacatttttaaaaaaatcaaaatcatatcaagcatcttcttgcaccacagtggaaaaaaactagaaatgagtaccaagaagactccttaaatctatacaaatacatggaaattaaacaacctgctcctgaatgatctttggacaatgaaatcaaggaagaaattaaaactttttgaaacaaataaaaagagacatacaacatacctccacctctgggatacagcaaaagcagtcctaagatggaaatttatagcattaactgcctacaccaaaaagatagaaagatctaaaattagcaaactaatattgtacttcaatgaactagaaaaccaagaacaaaccgaaaccaaagctagcagaatataagaaataacaatgatcagagcagaactaaatgaaactgagataataaaagacaaaaaattaaaaaaattagagagttttctttgaaaagataaacaaaattaataggccactagctagattaaccaagaaaaaaacagaagaatcaaataagcaaagtcagagatgatagatgtgacgttacaactgataccatagaaatacgaaagattatcagactactatgggcatctctaggtacacaaattagaaaatctggaggaaatgaataaattcctggatacatatcaactcccaaaattgaaccacaagaagcaaaaatcttggacagaccaataacaaatagtgaaactgaatcagtaataaatatctcccaataaaataaagctcaggaccagacgtattcacagccgaattctaccagacatgcaaagaactggtaccaatcctattgtaactgttgcaaaatatcaaacaagaggaaattctccctaattaattctacgaagccagtatcaccatgataccaaaggcaggtaaggacacaacaaaaaggaaaccacaggccaatatccctgatgaacatagatgcaaaaatcctcaacagaatgctagcaaaccaaacccaaaagcataacaaaaagataatacatgacaataacgtgagctttatgccaggtaggcagggatatatgcagagcaatatctgtgattcaccacataacacaatatatgttttgtgtggtgcaatatatgcagagcaatatatgtgattcaccacataaaaagaattaaaaacaaaaaacatatgatcatctcaatagatgcagaaaaggcatttgataaaatccagcctctccccaagataaagaccctcaacaactaggcattgaaagaacatatctcaaaataacaaaagtcatatatgacaaaccaagagccaacatcatactaaacaggaacatgttgagagcacccccctcccccaagaactacaacaagacaaggatacccattttcactgctccaattcaacatagtactggaagtcctagctagagcaatcaggcaagagaaagaaataaaaggcatccaaattgggaaaaagaaagtcaaatgatttctcttcactgatgataggattttacatctagaaaacccttaagactcctccaaaaggaccctatatttgataaatgacttcagtaaagtttcaggatatgaaatcaatgtacaaaattggtagcatttctatacaccaataatgatcaagctgagaaccaaatcaagaactcaatctcatttacaacaactacaaaaaaaaaaaatacctaggaatgcctttaaacaaaaaagtgaaaggtgtctacaaggagaactacaaaacacccatgaaataaatcatagatgacacaaacaaatggaaaaactttccctgctcatggattgggagcatcaatattgttaaaataaccacactgctcaaagcaatttacagattgaacacagtccttataaattaccaacatcatttttcacagaattagaaaaagatagtaaaatacatagagaatcaaaaaagagcccaaatagtcaaagcaatgctaagcaagaagaataaagttgaaggcatcacattacctgacttcaaattatactaaaaggctacagtaaccaaaacagtatggtactggtataaaaacagatacatatagattgatttaaccaaattaagaacccagatataaaaccacatatctatgaccaacacatctttaacaaagtaaaaaaatgtatatatacactggggaaaggacatcctattcagtaaattgtgctgtaaatattggatagtcataagcagaagaatgaaactgggtcataaatcaccatatacaaaaattaactcaaaatgtattaaagacttaaatgtaagacctgaaaatataaaaatcctaaaagaaaacctaggaaaaactcttctcgacactggcttgggcaaagaatttatgactaagtactcaaaaacaaaagtagacaaatggaacttaattttaaaatcttctgaacagcaaaaacaaacaaacaaaaaaacaaaaaacaatcaacagaatgaacagacaacttatagaatggaaaacaattccgaactatacatctaacaaaaaactaatatctagaatctaaaagtaactcaacaagaagaaaaatagataaccccattaaaaagtaggcaaaggacattagcagacattttttaaaagaagatatacaagtggccaacaaacatatgagaaaatgctcaacatcactaatcatcagagaaatgcaaattaaaaccacaaggagatatgatctcacaccaatcagtatggctattatttgtttttttcaatgtcatttaaaaatttgtgggtacagagtaggtgtatttgtggggtacatgagatgttttgatacaggcatgcaaagtgaaataatcacatcatggagaatttagtatctatcaccttaagcatttgtcctttgtcttacaagcaacctaattatatgctttcacagttattgtaaaatgtacaagttattattgaccatagttactgtatgatatgatcaaatattatgtcttttcattctttctaactgtaatttttgtacccaataaccatccccacctcccttccaccacccttcccagtctctgataaccatccttctactctctatttccatgacttcaattgttttaatttttagatcccacaaataagtcagaacataagagatgtttgtctttctgtgcctggcttatttcacttaacataacgatctctagttccatccacattgttccaaatgacagtatctcatttttttaaggggatacctgtcattaaaaaagtcaaacaacaacaggtgttggcaaggatgtggagaaaagaaaatgtttattcactcttggtgggaatgtaagttaatataaacattatgtaaaacagtatggagatttctcaaagaacttaaaacacaactattggatcctgcaatcctagtactgggtatatactcaacaaaaacaacaaaaagtgttacatgaaaaagctacctgcagttgtatgtttatcatagcactatttacaatagcaaagaatcaacctaagcgtccatcagtaaatgattggataaagaaaatgtgatatgcacatgtatatatgtgtgtatatacgcatatatatatatatatatatacacacacacatacatatatatacacacatatatacacacacaccacagaacactacacagcctaagaaagtatgaaatcctgtcttttgcagttacatgaataggaactataggccattatcctaagtgaagtaacttggaaacagaaacctaaatgcaacatgttctcgcttataagaagaaactaaacaaagggtacacacggacatctagagtggaataatataaactggaaactacaaaagattataggctggtaggggggtgaggggtgaaaaattacctattgagtatagtgttcgctattcagattatggatatactaaaatcccagactccaccactacacgatatatccatgtaacaaacctgcacatgcaccccctcaatctattttaaaacttcttctaagacatgcttattactagagttaaatgagacaatacattaacttcagcttgtacagtgcttagatttggtaggtggtgaggaaatgcttattttctttcatttctgacgtattcacattatccttgcattcttacactgagattcatggaaatagcccttttgagcatcactatttatttctaataacttggtaatcacattatatttccattattaaatatcctcagtgtgccaaaactgtagaccattatgtaaaaatagtttagtgcttttttagtcttactagatatgacttagataaaaatttaattgttaaaggatacagtatcattacttccaatgaataagagagtactaccagatgtaccagtagaaatctactagtattagaaatccactagaaattctgttcataacagaaatattaaacaggatagttctccatattcttcagaaaaagtatcatattcaaccttatattttaacacgggattggatttacggacatgcattttgttataagatacggtcatacatttgataaggaaaattattgccttaaaattcatgttatcatgtgtgtcttagctttcttgtaaggtttccctaaaatgcattttaaaatgttttttataattagtttatctacattattaattttgtattacctatacgaaagaactgaaattgattgttacagtactggttcagagagagagagacattttacatgagactaactcagtaaattagaaatagggtacttatttttttcctttaaacaccattggagaggtcagtgtcttctcatgaggaagtattacaagagtaatgaagtataataactaatgttagtgcctctaagatgacagagtcttgatcaggtataattttcgtagctataccgatatactgtcaaacaaagctgtgacattctaagtaatgttactgaatcaatactcagtaatttctaataaagtaaataataatctgatagctagaaatacttgatttgtaaaataagaatatgggcatggattttatattattattattttaataatctatagcattactgtgcaaatatacccttggaatatgatgcttgttaatagaattcttatgggatattagatgtcttctcaattcgattttaaaaattgtaactgaatatcatgcacatactactacgtagactataaaagtgtgatgttcttttttacataaacttccaatcatttatgtcaaaataatactaccactcaaaccaatttcatagtcaatggtttagcactattaagatatttgcatatgggaatgcaacagagatagaaggaaaaaaggaaagtcagagattgaagacaccagagataacatcaccaggtaagccactttacagatgtatttttctacagctttatgaatttttttttgctgtatgcccaacgttttaattgaaattatcaaactttcatgcccttgtcagaaagttagccatgatggagacgatttggataataaaactagtcaatataatcagaacatgtgttctaaaaacatttactgagcatcaattattgactaagcactctgaaaacacaaaagaaatctggctctctggttataatacagtattttttcagattatagtgtttatcccccttaccatcataaccattaaactttcattaagcacttatgagggcaaaagacaggaaataaaatgaaacttcatagcagaaacaaacaacatgtaattttaaccttgctaaatatgagagtgagtttgctaaccactaaaagcaccacttgatcctatggcactgtcaaacttaactgaatcacttatccttcttccaactattgcatttctctttttcactgcctattttcttaattaccaatctcaagtcccaattgcccagtcccagaatctattactttgagctttttgttcatatcctaaatctagtcctattggttttgatttgatatccagaatgctttgtacctgtttacaatttttgttgtcattgctttcattcaggctctatatactttcagcaatatcctcttaacatgttttccggcctcctgtttctctgctcttttatttatcctcaaaaaatatcttcttaaatattaagataagttttcctaaattgctgctatttctagtttaatttctcatgaataatggtttcctgttactcatagaactactactgcaaatgcctgagtcttttatataagactcatgatcaccctccatgatcaggcttaaatcctccagcattcagtatagtacaagacatcgtaaatgattggtttctgcattcttcacagcacccatgtgctataatgagggtttgttcagtgatatggaatagaatgcaatggaatgaaatgaaatgtcagatcctttggcagaattatacctaatccttctctgtaacatgaacatctagatcattttaaaggtcaccagatgaggatatttcacaatcttggcaacccaaatgtctgcctttaactaaccttcaagaaaaggataggtgactgagtttctaagaggctacttagtttgtattaatcagtatttcacatataaccttcactgaagtcagaatatagagtatatattcacatcggcaaattcttgtaatttgtaaagtctttgttgatgctgtcaccaaggttatgcatctatgcacaaaagtctaaatctctcaaaagaatggaaaacctagctagtaaactcagctttaaacttcatcgcagtctcactgtgccaggagacaaaagatttcactgttaaatattttccttttgaaaaaaatgcctccaaaatggcaaacttctttactattaatgaaagctcaaggcttttcctcctcaatagcatcatgccactccttcgagggaaatcctttcattctttgtcaacatcactaataaattctaccccttaagacaaaaaagaccagctagaattatatgtgatatattttttcacaggggaatgagaggttcgatttgtttactccccagaaagactcactcttgggtgcctcaaagctaaagcaaacctctaaattctctccctacagcaatgtctatgaaggatgagtggtttctcccaaatggtgcagccaattgaacttttcttggttacccagagtaaagagtttggctagatttaatagtaaccaccatataggatcaattgctttaccttacctaattgccaggttcagtaaaagtgacttatcttcctgacatttcacagtgtctgaatttctagcctgcctcataataaaatgctgttgaaatgaagatagcaaaggatcctgtcacagaatatacagaagcatatctgtaatattcacagtgtacttgcaagatttgcaaacattttaatcttgccctccagttgagagagagagagcaggcgacctctgatctgagcagaatttaaatcaattcccagcaataaaatctgtatcttttctttaattttgtcatctgcaatcatctttaagaaaaaatggtgatggcacaaggatttaatgtctatctacacaaagctaaaaataaatattatattaggttagaagtttggtgatgcagcagatgggagttgcttttgtggggactctaaggttactgatgcattttgttgtcagaaggagaaatttccttactttcaatgatttacaattcttgggaaaaaaagctgcaaagcgattcaacgactatataaataaggctttagtttgaactcagttacccaaagaagtaacatttattttcttttgttttatgaagtgtggcaagactaacaaaacagtgttcctttaattctgtatgtatgctccttttagtcttaaaagacaatataatgtacatgtttcaggtttaaataaagtcaactctttgctaaattgtttgatgttaagtcaccttcttctcgccaaaattgttgccaagaaacaaaagagcattatcaatattcaggacttgaatatgaatctttcccttaatttttataaaaaaaaaatctgtcaaatatttcaaaaaatattgtcaaatctgtcaaaaaaaagagtgctcaaatagttaaaagtaggagttggccttactctctgagccagaaaaccaatgccttctggcctctttatgccctttaaataaataaataatgcctggaggtaaaatgttacataatcaacttgcatatactcctgttgccttcttttgtttcacattttttcttcaaggcaatttcatagtcattagaaatggcatactttcaagtaatgaataatatatttaaattttatgacaatatttgtcaaacgttttccatttcattcacattatatctttcagaaaaaactacaaaacatttcaggtacctggcagaatattaagatcctggatagcttgtctcaccttaatgaagagtctgttcagcgtcccaagctaagaacttccttcatagctgccctaggttatccgtacttagctatgctaacattcttcttctactgctcttttggagctcttctccctggatttcgctttacactccaggcatccagcagcagtgtcctgccttctgatgttcagtgttacgtggcctaatcttggccttttctaaaatacttcaacttccaaaagtattggacacatttaaactgtgactggaaggaacactagaaacaaactcactcttttatttccaaagtaaagatacagagaacctgggacattaagtgatgtttggaaaatgacaatttagttagtggtagaactggagctcgaattctggcttctagtgggagaagtttgtcttgggttagattcctccaaaaacacatcctgaacaaaagatttgtgaacaaataaatggtttatttggagggtgaactcgtaaggcattatgagagcacggggacgttcaggaagttaccctgtggatacctggagctcagtcttactggggaatctctgaaagactgtggagaatataccttagaaatgtcccactatgggacaaagattctacaggatttctctatcaacttttactcctcattggctaagggcagctctggtggcactaattccacttcctgtccaccttcaaactggctgaaatggttctgcaccagaaataccctccggtagagagaagccattgctgtacatcaaccttgtccaatccatgacccaggatggctttcaatgtggcccaacacaaatttgtaaactttcttaaaatattttttcaattatttcttttagttcaccagctatcattagtgttagtatattttatgtgtggcccaagacaattcttccaatgtcgcccagggaagccaacgggttggacacccctggtttatatagacactttctgcatgtaacttccagtgtaggccaagggaaagagggcagatatagtgtcaacgagagaagcaaatgtgccacatcggaaaagcggtacggttagagaactagcactgtacctaacttcttcttcaggtgctcaattagtatctatatgacaagtaatcacagttacaatttctacataattgcaatacagttgatgtttttttcctgatggcatagcagacggggattaccatagttacagttcttcttaaatgctagatcttagaggactcctgggggtcaataatagtaagggctggccccatttgtcattcaaaactgaagctcattaaacttaaaaaaaactctagaacttagaaataaatgtatctttcatttgcatggaagaactgtaaagctatatatgactgaatattataaaaagagagaattaagtttgacaaaaggcagatttcgaaggtatgaggtaaaggagcagatattcctattcaaagccataaatccaaaaaccacagatcataagtagagttgccagataaaataaaagacactcagcaaaatgtgaatttcagataaacaatgaacaatttgggacacacactaagaaaattatttgttgtttatctgaaatttacatttaagtaggcttcttttatttgtgtctgctaaatgtggcaaccctaatcctgggacaattacaaaggatcttgtgtgtgtgtgtgtttcctcatgaattgagcaggagcctatttcaacaataaaactcagagctaattgtaatattttatggcacttattaaaataaagcaccctcataattttggataagaaatattattgtagaagtctcaataacagaaacaaaaaaaaatgctttctggcagcgagggagcataactggaaatgtacaagtaaactgaagaaaaaagatggaaatattaacatttaaaaaatgtcatattctatagaaaagcaatgcttcagactctcatttatcatcaagcttggccagcttcaatttactataaattgaatgtaaaattacattaaaaaaaatcgtagccttattatttaaatttgcattacaagtaatccctatgaagtctgtcttccaggaaagcaaatttttaataaatcacataccctgcgttgttctcatccacaaatatgtttgatttcttttccaaatacgaaaagcctagctatgctgtattttttaaaaaaacaacaacaaatgtcttaatccattttgtgctgctgtaacaaaaataactgagaatgaggtaatttaggaagaatgtacctttattttttcacagttctcgagtttgggaaatccaagatcaagatgttagcatctggtgagggccttttcacagagttttcacatggtggtgcatggtggagggtcaagagataggagaacactgtgtgaagcctcttttatatgggacttgatcctattcttaagggaggagccctgatggattattcacccttaaatattccatctcctaatacaatcacctgaattttggaggggacttattcaagccattgcaacaaagattgcaaaaacaattaggtaaaaataatttttaaaatatggctgactttaagttttaattctctcccatcaaccatgtcatctgtgttactgtgtataggtactatacacagagtttgctttctagtagaaagcacgcaacataagatacacctaccttatgttgttgtacttggcgttttaggtcttcaagatcaggtccaagaggctcttcctccattttccttgttctttcttctgtttttgttagccagtcattcaactctttcagtttctgattctggagatccattaaaactctatgtaaactgaaaatttgaaagaagcctattatgacctctttgaaagcaacttattactgaacatcacaatgtaaaacaatagaatttataatatatggaatgttcgcatttgggggcatctattggacattgagaaggatgtaagtaaagcccactatcagtcaccccggaactattatttctcagacttataatagttcacaaatcctgatttctaaaaactttcacatagtcaactaaatgtgaacatgctaactgaagtgcaaagcatctgataattgactaagtagtatattttggcagttgttcgtttacattctcattatttagtatgtgtggtggttaaagatggccacaaattctttgtcacttttcccttcaagagatgaggtctattttccatccctgtgaatatgatctggacttgtgtttttttttttgaccacagaatgtggcataactgacaccacaccaattccaagtgtaggctataaaagaactggcagcatttgtatttcttcctctcttgaagcctagattccatgctgtaaaggaggccaggctacactaccgaatcattagagaccatataggagtgattctgcaggataaaatactgtattagaagtgagcttccagctcagcacagcccaaggggtgacccccagctataaaactagtaatataaaaacaacctggctgagccctgcttatattctcggtcttcagatcatgacgcaattataaattgttttaacccattaagtttggacgtcatttgatacacacaaatagactagagaaagggtgctttttccccacaaagatatagaaaatagtgggctgggtaatgaatttaaagtccaaaggcctaggttcacagcccagcggtaagctctacaaccaggttcttaaacgttctcaattacatttccagcatcagggacatgggataatgttttgcctattaattacacaactttatgttgaggatgaaaacacattattgttcattcattaattcaaccaaaatttgagatgcaaatgagaagtgctgatggttattttaaaggaaatactctttataaacatcatgtttaaagcatttttcaaaactatattctgaacattgatcttataatttgaattaggaatatgttattttgaatacataattttactctaaaatctttactggaagtttccattaatcatcacatttaaacacacaaagtgcacacatagctgagagtgttttttaacagatttaattttttggctgttttagattcacgaaaaattaatgagattataatacaaagagttatcatataacttgcactcagtctcccgttttattaacatcttatgttattatggaacatctcttacaattaatgaaccaatatttgtgcattagctggagactattattatattctgatttccttaaactattttttgtatttcagtatctctccaaggattccatattacactcaattgtcctgtttccttaatctgcttttggctatgacagtttctcagaatttttctggcagtttttaaaagtgctggccaggctggtattttgtagtatgcctctcagtggggatttgtctgattttttttcctcataattaaactggggtttttgaaagaccacagaagtaatgggccattttaagcacattttataaagcatatataccctcaacgtgacttatcaatgttaaatgtgaccacctggctaaagtaataggtgtcatgtttatccactataaagttactctttccccctcttttcacactgttttttaataagaaagtcactatacacagcccctgtggagtggggagttacattccctctccgtgagggcagagaagttacataagtttttggagttttttctgcattggagatttgtctctattcctccatttatttatgaaattatttatttacatagcatggactcatgtatagttatttgatactttgggctaaatccaatactagtttttgctttggatttttgctcaaatagttccagctttggacattgggaagtctcttagttggcttctttgacacatcccatcagtgttttttgtttagagcgagaccgtggagtttagcatgttcttactatctggcactaccaaatgttccaggctcattttctatattccctttcctagtgttagaatcagctgtttctccacagtgttctggttcctttttttttttttttttttttttttctttaaagaatgttactgaaacccaagatcctgttgctaggtatgctccttgcttctagggtgttgtagcttacaggacctctgggttgacataaagaagtggatgtgtgagtgtgtactcacccataaatacttctatatataattatctcatctgtattaacctaatattaatttatccatctctctccaccttgtgacttctgttccttatctgtgaactacctcttcaacttttttttgaactacctcttcaacattttgagttataagaaactcaaaaatgatttctttaaactagaagttgagatgaccgctgttcatgtttggctcctcatgctgctgaatccacagacagagaaaggggttaccatacagaacctaagcacaaatggtcaactgagttcacccaatacaatgcggggcaagtagtactacattagaaaactatgggcatttgccaggagtctcttagtatacccatatatgatagtgttaaccaataaaaaaaacagaagatactcgatcaatatggaaacactaataatatggttctttggaaggatgttttttatttcccactaaggtcaaagtacgcaactagaagaaattctgccatagtaaccaagacagcattgtattagcataaaaactgatcagtggaacataatagagaacccaggaataaattaatgcatttgcattcaactgattttggacatgggtgtcaagaacacaccgtgaggacaggacaccctcttcagcaaatgctaccaggaaaagtaagaatctacatgcagaagaatgaaattagacccttatcccttgccacatacaaaaaccaatttgaaatggattaaaaacttaaatttaagactcaaaactctcaatctattagtagaaaacatagaggacaagcttcatcacaattatttgggcaataacttttgaatatgactgtaaaagcacaagcaacaaaagcaaaaatagactgaggacttataccaaactaaaaatttctgcacagcaaaaaaattaaaattaaaattaaaaattaacagagtaaagagatatccaatagaatgagaaaaatatttgcaaactatatatctgatgggggttcatataaaaatatggaagaaattcaaccaactccatagcaagaaaacaaataacctgattaaaaataggcaaaagaccaaaatagacatttatcataaaagggacaaatggataacacagatatgaaaaaatgctcaacagcactaatcatctgggaaatgcaaattaaaaccacaatgaggtatcagcttacttgcaaagaaaagggaacacttatacactgtttgtgggagtgtaaattatttcaactattgttgaaaacagtgtggtgattccacaaagacctcaaaacagaactaccattggacccagcaatcctattattgtgtatacacttaaaggaatataaatcattctaccaaaaagacacatgcacacatatgttcgtggcagcactattcacaatcacaaagacaatcaacctaaatgcttatcagtggtaaactggataaagaaaatgtggtaaacacataccatggaatactatgcggccatgaaaaagagtaagattatgttctttgcagaaacgtagatgaagctggaggccattatccttagcaaaataacgcagaaacagaaaaccaaatacaccacgttctcacttataagtgggagctaaatgatgagaacacatgggcacatagagggaaacaacagacatggggcctattggagtttggagggtggcagaaggaaagaattaggaaaaaataactaatgagtactaagcttatacctggtgatgaaataatctgtacaataaacttccatgacacaagtttacccatgtaacaaaactgcacatgtacccttgcacctaaaagttaaaatataatagtaattaacgatatctttgtcaaaagaaaaaagaagagattatcacctcacttttgttagcatggctactatccaaaacaaaaaaagataaatgttgataacgatttaggaaaaaggcatgtattacgtacctgcaaaagttaaaaattactaattaaaaaaaagaaaacctttacacactgtaaatgggaatggcaatcagtacaggcatcatggaaaacagtatgaaggctccttgaaatatgaacaacaaaactacaatatgatacaaaatcccactatgaattatatatacaaaggaaatgaaatcagtatgtcaaagaaatatctgcactaccatttttattgcagcactattcatggccaagatatggaatcaatccaaatatccaccaacatatgaacggataaagaaaatgtggtatacatatatacaatggaatactattcagccataaaaaagaataaaatactgtcatttgcaacaacatggatgaacctggaggatattatgttaagtgaaataagccagtaaagaaagaaaaccactgcctaatttcacttatatgtggaatctaaaagagctgatcccacagaagtagggaatgaatagtggttaccagaggctgaggtggttatggggaagggggaggtatggagatacttttcaagggatatatagtcacagtcaaaatattcaagtgatgtattttacagcatggtgactacagctaatgaaaatatactcttgaaaaatgtagagagagaggacgttaaatattcccaccataaaaatgataaatatgtaaggtaatgcatatgttaattagctagattcaactgttccacaatatatatttactcagaagcatcacgttgtacatgatgaatatacaattttatctgtcaatttaaagtagggtttaaaaagcaatgtttagaaattgatagcatttcaaacaataaaatataaaagttgggtctgttgagtgtgtgtgtggatgctgcatactattggcaggaaagatagaacacactcaaatatgtttcgctcagtagactacttacacatttatgtgaagggtcgggggaaaaataataaacgatagtgaaggagccaggacctaacaacaaagacaactgacctagcatccccggaactggaagaaaaaaggaagagagctgttgccggagctcagtgagaattagagacatggaacaagagctgtccaacagtagctgtagtttaagaggaacacaattccagccactccacagtaagaaacagaagaggaagagaaaagtaccacaatctctgctttcaccctcttgccagtgcctcccattggctgaagtactttagcaaccaaaggccaagaggaacctgggtaacagaaaatctagacttcatcctctttgaacagagcaagaaggagaaaagtgaaatgaatctgctaaacagagtaactatcaaaatacttaaattagtataagtgtatttaaaacaaaaggatacaaaattccatcagcatctttatcctcatacactaatgccaggctatttaaaccccaacatggaacctgtatgtaatgttacataccactcacactcttcatataaaattacagggaaacaggggaagtaaaccagtaaaataaaatataaaagataatggctccatagctggtccgaagtattggggttgttatcagagctttcttccaatatgcatttcatattccttttgagagtgtttacaataatttagattgcactatttattgacttttaacattttagagacacatttaccatgaggaacattgcaatcagaagttatgagaataaactttcatttatcaaacacaaaaagtagacattttatttttatgagaaacaacagagatgagatatccatttaagtggaagcaaaaactgaaagttgctagtatttgaaagcatcatttactttttgcttttggacagacatttccttcaacaaatctttactgagtttcatatctatgcaggaaactcatatttgttaggaatggacaaaatacctatcttcaatttcaagtagcttagagactattagagacataaatacaaaaataattagaatataagaaatccattataattagatttatatacattcctgagggagtaaggagaggatacaaattgacctgcagtcattgggaacagtgtcctcgcagaacacacagcctaagagttgagacttgaaaaattcattcattaatttacgaaatatacaattattgagtacctggatactacggatggagaggcaaggaagaccaacacagccccttgctatcttggagtttatatggatggcgggtgagggccacagataatacatatagctcaacaggccattagttggttataatgtgatcatactatgaaatgagagcaattgaattgagtctgtaaaggggggcctttagtgcagtactggacaactgtgaagactgaagtcagaagtagtgaaaaagaaggtataaactctttctagacggaaagaaagacctgtgaaaggccctgtcacatcacagaggaaccggaaatccagtgcagcttgatcgcacaaggtgcaggatggttgtacagtatcatagcctaccttaatctgtgggtccacagagatttcttgagctctgccccaaatctgaaatttgaacacccagtaatctttcatgttctatcgtggtttcattttacaaacttggactcagagattgaccaataagaagagatgtacacataagtgttttatcttctttttttttttttctcttaatagagacaaggtctcattatgttgcccaggctggtcttcaactccttagctcaagcaatcctctccccttggcctcccaaaagtgctgggattataggcgcgagtccccgaacccagccaggtgttttctctttataagtgggatacagaaacatctggttggggatttttggggtagggaccagaatggctgggtgtgtgcaaacgggatggctcaatattttaatgactggtacagtcacatcaatgtctcccagccaaatagagccctgctttttctctcttcattagtggttctgaaagtgtggttactggaccctggaccaacagcatcagcccatcccctagaaacttgctagaagtgcaaattcaaaacttgctagaagtgtgtgcaagactcacacttactgaatcagaaactctgggatgaggtctagaaatgtgtattttaacaggacttccaggtgactgatgcatactcacacttgaaaattactgctctaggtaactttattctacaaacacaactcacccaaattctgcagagaccaagatattaacattaataggaggacaactgccaatccccaggagattactatgaattattttgacatgagacttttacattctcttcctgacttcacctccacttacagagagaagtgtgactgccaactgccaaagaatgggttctacctgaggctccaaaaagcaggatttcatgtgtctgaagcatgaaattaacctcagaacaagtttgaaaacagaagaacctaaggattgtggaggtgtgatactaataagcacgaaaacaaaaagcattcatcccattgttggaaaggattctgagatgttttaattgagaaaatatttcttttccttactacaggccttgactagatattagcaaatagtagtccatatgctggatttggtctcatactaattgaaaataaattgaaatttttgccagtagttaaaatttgagatattagctacaaatatcaaatctgaccactcttgatcatatttaataggattcagcaaccctaaaccttccttcctataggacaaaattgagtatcaattatacttcacatccaattatacttcgcatccaattatacttcatatacaaagtataagctctccagtttgctgtagtcctcatcactccctatccttttttatacgcaactcatctcacttccttatgttatgtttctggcttctacaataggcatttggatttggtgccccccggggtcttgatcacagcttctcaaacttaaatatggatacagcccacctggtgattctgatttaaattcacggggttgggtcgaagaattcagttctaaccagcttccaggtgaaaccaatgttgctgggtcatggatcacactttgaatgacaacattccaggtaagaatattatttatttgaaaaccactgctagtctacttaaggtatgtgttcgatctattagttactactgctaaaactcagaagatatagatttatgtgacactggcagggaagtatcaaagggtatcagactcagaatgcccaagtatgcccttcagtaaagtaaggaagggctttattacagtactgatatgtgaaaaactctaaagattgaaataactagtaatgaagaggacgcttccttccttcactgaggcctgtgaaaagagcatcagtaaagtgcaggtgaattataggccagagttttctgggtgattagcaaggaagtgagtagtggtccattgcaaggctgaaccagaggaagaagcaaaattgaaggaggcactgatatcagaaggtgagtttaacagccttcatgacacaaatgtcctttttcccaaagatggtttaaataaaggggtgacttcagggagtggggaggttaacctctgggttaaaatgtcattaatattagttgtaaaatacactggctaacatttattcaactttttttaacataaccttgccaaggtaaagatttataatactagtatttttttttttttttttgagacagggtctcattctgttacccaggctcgagtacagtgacacaatcataactcactgaagccttgacctcccaggcccaaatgatcctcctgcctcagcctcctgagtagctgagactacaggtgcaccaccttccctggcaaatttttaactctttttgtatagatgtggtctccctatgttgcccaggctagtcttgaactcctggtctccagctatcctcctgcctcgacctcccaaagttctgggattacaggcgtgagccaccgcacctagctactgttattttatttctgaggatagtggtaggttaaagagctggcacagtggcatgtgaagccagtatagaaatcacaaaccctgtgtgacccaagactgtgcactattttatttttttcatgggcaaaatattgtattagatcatatgaaatttctgatatttcaatttctttgttgatgaaaatggcttcatatagttcaatttaaaacatgatgaaaatgagacaggagtttcttatttccagctaacattctaaagatgtaaataaatttggaaaaattgtcaaagtcacaaaataaaaatctaccatgcacagataggaaaaaatgtttgcatttttccaggtttcattttatatccttcaagtcgtcatttagacgggaaagtaaaagcaaaaggtgaatggagtatacatatatgactggcaatagagagccgagggagtggaattagaataaagtagtatagggcaggagttggtcctgacagtaggtataggcaaaagcatatcaggacatgatactaggaactgctacggtaaacttccaatcgttcagatcatctgagaatagagaggggctagcaaaacagataagttgtaagaacttggaactttggcaacatagagttacagacctaatggtctctagcgtcaacgacatttttgatatattgttagataacagacatccttatgattgtgcccagtgtttctcaaactttaatgtacatatgaatcacctggagagtgtcaaactatgcattctaagtcagtaggcctgggttggggcctgagattctgcatttctaacaactgcccaagggatatcaatgcttcggatccattaatcacattttaaggagcaatggtataagtcactttgagttggcctttttgtcatttgcagtaaatggcattctaagacgtagtatttttcaaatgattttactcgagagctgtcatcccacccccggacatgaaaacgtatctgtatgaacataaaggaattcaatgggaatgccagctttgctttacagaaactctgttagaatgtaggaaggcggctgggtgcgatggctcacgcctgtaatctcatcactttgggaggctgaggcggcggatcacaaggtcaggagttcgaaagcatcctggccaacatggtgaaaccccatctccactaaaaatacaaaaattagccgggagtggtggcacatgcctgtagtcccagctactcaggaggctgaggcaggacaattgcttgaacccgggaggcggaggttgcagtgagctgagttcgcaccattagactccagcctgagtgacagagtgaaacgccgtttcaaaaaacaaaaaagaaagaatgtaggaaggcaattattctttaaccagtgttgtccagaacttactaaaatgatgtaaatattctatgtgtgcactataggtatacatatataatggacactagtcaggtgggaataatgaacacttgaaatatgtatggctagtaaggctcagaaactgaatttttaactatatttaattataataattataatttacctacacatagctagcggctgcaatattggacagcacagctataaaccgacagataattagattaccaatatccgtgaatccttatttgcaagtacttatccataccaatttattttgtcctccaatgtctatgaggaatgacatcctaagtttagcaatctagcaataaacattaatagcattttttaaaattttcattttccatatacaaatttataaatgcaaaatagtacatgttttcattaatttcagcctgtatttgatggtcctaatagcattttttgtgctttatggaaatacattataaaatgtataaacatatattatgaaaacataatcatatgctaggcactaactaataaaggcataaatggatagactttataaaacctagaggactacaattaaaacttacaaattaccaagaggtgtgagctctttaggaagacaggctctcaggcccaattccctagaattcacagttactggcatatatgcaatcctcaatttaaaaaaatacacctaataaaaggaggtaatgtattataatgaaagtctagattagaaaagaactaccagtgatgttcaattgacatgtcttacatgtaaaatacaattacatgatttaagtcagaaataaaacctgtataatatgatttaagggaaagataccagtacaaattagagaaacttaatttttaatgcatgtttttacttttaaatgcacgccatttagaaactaaaattgtactgatgaaaattggaattgatttatttacttattcaaaatgatggctcaggctgggcacagtggctcaggcctgtaatcccagcattttgggaggccgaggtggctggatcacctgaggtcaggagttcaagaccagcctggccaatagaaaccccatctctactaaaaatacaaaaattagctgggcgtggtggcaagcactttttaatcccggctactcaggaggctgaggcaggagaatcacttgaacccggggggacagaggttgcagtgagctgagatcacaccacttcactccagcctgggtgaaagaacaaaactccgtcttaaaaaaatagataaaaataacaaaacgatggctcaaaaattctagcaaggtggttcttatagatagattagttttggttttagcttaacaattctttatatgcaactagatgcttctagaatgctgtcatctgcttaaataagtaatttttaaaatcaactttgtttcagcttttgtttcattctctattaagaaaggtattgggggctggggaaggaatagcattaggagaaatacctaatgtaaatgagctgatgggtgcagcaaaccaacatggcacatgtatacctatgtatcaaacctgcgagttgtgcacatgcatcctagaaattaaagtataataataataataaaagagggagagaaaaaagaaaagaaatccaagataggttaaaaaacagaaagttattaattgaggtaatgtttaagtccggcttttattcaaactatcacagataggtgaattagtggaatttatataaataatgccttaatataaaaaggtactaattgattagaatcactgagagaacttttcaaaatgacgtcccagccccattccccaacaattcaatcagaatatctgggaatggagcccaggtattggttctgtaaaaaactatccaaccaggtaattcgaatgaacatccagggttgagaacgattgtgcctcttccccgcccccccccccgccccaggacacagccataatttttactttagcccttgggtcctcacaagtggcaaatacctggaaagctgtatccagacaacatgacttgttagggttaacatgaaccagatgcacagaggtaacatggagacaaaggatcaggatgcacaaacatgcgtttacttatttataaatgacttccacaagtactaaaatatctattatgtacccccagaaattacaaataaaaaagaagacttactaaagagtaattttgatcttgtagaatttggggcttttaaatataatttttaaatacaaaataataattgtgtgtcagaaaaaaagaggtattattgtaattaatcctattgattcagcaactgatattagccccaatttacaggtggggaaacaaaggcttacttgggtcaaaacgcaaacaagggaaggtgacaaagtgggaactcaggtagtttggctccggggcctgcttcacaatcatgcaatattgcctgaactaaaattaactttttagagattaactttatatctattataaagtcatttatggcactgattataaatattaaaaaaatagaaaacagaagttcatttggtggaattttatacagagattgtcattaataattttattattttcaccaaaacgaaaattacagttgttactcttgagacaattgttcttagcatgatgtttactttaatgatagaaaccacaataccctattttttaaatttttatttttttgggtatatagtatgtgtttatatttatgggatacaagagacatattcatacaggcatacaggcataatatgacattagggttaatagggtatccatcacctcgagcacttatcatttctttatgtgacaaacattccaattatactttttgttattttaaaacgtacaacaaattatgtttgacagtaatcatcctgtcgtgctatcaaatactacatcacattcattcaatctaactatatttttgtacccattaatgatccccactgcccccgacccactagcattcccatcctctggtaaccatcattctagtctctatctccatgagttcagttgttttaatttttttttttttttttttttttttttttttttttttaagctctcacaagtaagtgagaacatgcaaagtttgtttttctgtgccgggcttattttaatcaacataacgtcctccagttccatccatgttgttgtaagtgactggatctcattctttcttagtcaagcttaagacttgtcatttttgtcaaccctttcaaaaaaaccttctttttgttttgttgatcttttgtatcattttgttgtactttaatgtatttcagctctgttccttactgtaatatttattttctcatactaattttgggtttggtttgctccttcttttctagctctttaaggtgtatcattcaattatttgaaagttcttctgcttttttgatgtaggtatttatacctataaactttcctcatagtactgctttcactgcttcccataggttttggttacattgcgtttcctttttcattcgtttcaagaaattctatagtttccttcttaacttcttctttgacccactgataattcaagagcatattgtttaatttccatgtgtctctatagtttccaaaattcttcctactgatatcttgatatattcagttgtgatcagaaaagctaatttatgttattttgatttttgaattttctaagacttgtttcgtggcagaacatatggcttgtccttgaaaattatccatgtgctgagaagaagaatatgtactctgcagctgttggataaaatgttctgtaaatatctattagttcaaattggtctacactgcataataagtctgatgtttctttgttgattttatgtctggatgatctatctggccactgctgaaaatggggaattgaaatcaccggctattactgttttggggtctatctctctaactctaataatatttgatttatacgtctgggtgttccaatgttgggtacatatttatttacaattgttatgtcctcttgctgaattgacccctttatcattctacaatgaccggcgttgtccctttttatagtttttgtcttgaaacctattttgtctgataaaagaatagctaatcctgttcttttttggtttcgattggcatggaatacttgttccatccctttattttcagtctatctttatctttattggtcaagtgtgtttcttgtaagtaacagattattgtgtcttgtatattcttttatccattctgtcactcaatgtatttagattggatagtttagtcaatttacattccatgttatcattggtacgttaaggacttaaacacttcccattttgctatttcctttctggttgttttgtggccttctcttcattctctctttccttcctgtcttactattaatgaaagtaattttctctggtcatatgttatacattcttattaatttttatgtacctgagtacattatttgatttgtggtaactatgaggtttgtaaagaataagttataatccattatttgaaattcatgacaacactggttgcataaacaaataagcaaagagaaaactaaaaaaaaaaaaaatgctacactttaacttcatccccccactctttttgttgtttctatttatatcttattatagtgtctatgtcttgaaaagttgttgcagttatttttgataggttcgtcttttagtctttttactcaagatatgggtagttgagacatcataatcacagtgttataatattctctttgtaacagaatagtaacaaaccttactatcaccagtgagttttgttacttcagatgatgactcattgctcattaacatccttttctttaagattgaagaacgccctttaccatttcttgtagaaaaggtttggtgttaatgaaatctgtcagcttttctttgtcttagaaagtcttcatttctccttcaagtatgaagaggattttcatagatatactattctagaataaaagtcttttccttcagcactttaaatgtatcatgccactctcctggcctggaagttttccactgaaaattgtgctgccagacatactggagctatttctatgtgatttttttttttatatgattaccgcttttaagatcttttctttatccttgacctttggaagtttgatttttaaatgccctgaggtagtcttatttatattatatctccttggtgttctattatcttcttgtacttgaattttaatctctctctctaggtgggggaagttctgtgttattaccctcttcaataaactttttaggacttttttgtctcctctgactgtatttacaaatagcttgtcttcaagctaattctttctcctgcttgatcaattcttctgttactcgtctctgacgcattcttcagtatgtcagttaaatctttcaactccagaatttttgttcgattctttttatttcaatccctttgttaaatttatgtgtaggattctgaattccttctctgtactatcttggattttattgagcatcctcaaatcagccatttggaattctctgtctgaaaggtcacatatctgtctctccaagattggtcagcgatgccttatttagttcagttggtgagatcatgttttcttggatggtcttgatgcttccggatgttcatcaatgtctgggcattgaagactttggtatttattgtagtctttgcagtatcggcttgtttgtatccatacttctcaggagggctttccaggtatttaaaggttcttgggtgttgtgatttattcctttggtcactgcagccatatatgcactggggtgcacccaagcccagtaatgctgtgactcttgcagactgttaaacgtactgccttggtgatctttgggaagattcaggaaaatcccctgtattacctggtagataatctttttctctttccttcccctcaacaaagagagtctctctctgtgatgagctgcctggagctaaaggagaggtgacacaagcacccctgtagctaccacgactaggattgtgttgggtcactcctaaagccagtacaacactgggtcttgatcaaggcccacactgaccactgactggctatcacctacattcactcagggcccaaggactctacaatcggcaggtggcaaatccaatgaagcttgtgtttttcacttcagggtagcaatttttccctggtgggtttgcaagatcctatatgtaagccagggcctggggtcatgtattaggccattctcacaatgctataaagaaatatctgatactgggtaatttatgaagaaaagaggcttaaatggctcatggttctgcaggttgtccctgagacatgatgctggcatctgctctgcttctgcggaggcctcaggagatttacaatcatggcaaattgcgaaggaggagcagtcatgtcacacggccagggaagaggtgagtgggagggtaccacacacttttaaccaactggatctgacaagaattcacccactatcatgaaaacagcactaagaggatagtgctaaaccattcatgagaaattcaacgccatgattcattcggctcccacccaggccccacctctgacagtgaggattgtaattcaatgtgagatctgggcaagaacatacatccaaaccatactattccatcctggcccctcccaaatctcaagtccttctcacatttaaacatacaatcatgtcttccaaacagtcccccaaggtctttacttattccagaattaactcaaaagtccggagtctcatctgagacaaggtaagtttcttctacctatgagcccgtaaaatcaaaaaccaattagttacttccaagatacaatgggattataagcattgagtcaacactcctattccaaaagggtgaaattggtcaaaagaaaggtctcatgcaagtctgaaacccagcagggtagtcattaaatcttaaaactccaaaattatctgctttgactccatgtcctacatccagggtaaactggtgggagtggtgtgctcccaaggccttgggcagactccaactttgtggctttctagggttcagcttccaaagctgctcttatggtctggtgctgagtgtgtgtttcatttccagatacaagggtcaagctgtcagtggatctaccattctggagtctggaggacagtggccctcttcttacaggtccactaggcaatgccccagtggggactacgtgtgggggatcaaagcccacattttccctctgcattgccccaggagaagttctctgtgagggttctgcccctggagcaggcttctgcctggaaacccaggcttttccatacaacctctaaaatctagatggatgttcccaagcctcaactcttgcactctgtgcacctgcaggcttatggcttgtacccgctggagctgtggcccaagctgtacttgggccactctgagccacagctggagctacagtggccaggacgctgggtgcgggggggaggggttggggcgggggcacagtgtacgaggttgaacagggcagctgggaccctgggcctggcccaggaaaccattctgtcctcttaggcctccggatctataatgggaggggctgccttttagatctctgaaatgccttccaggcctttttccccattgtcttggctatcagcacttgccttctttgtaggtatacaaatttttctagcaagtggttgctcagaagccttcttgagttctcctgaaaatgggcttttattttctaccacatatccatgttgcaaattttgaaaacctttatggtctgctttccttttaaatatacatgtataaatatgtaaaaaacctgcacgttctgcacatgtatctcagaacttaaagtacaataaaataaaataataaatattccatcttatttctttgctcctgcatcagagagtaggttgttagaagtggccacacaacgtcttgaacattttgctgcttagaaattcattccgtcagacacacgagatcatcactctcaagttcaaactttcacagatatctagagcatggacataatacagccaacttctttgctaagggataacaaacatgtcatttactccagttgccaataagttcattctttccatctgagacctcgacagcttggacttcactgtgcatatcagtatcagcactttggtaacaatcatttaaccagtctctaagacattccaaattttccctcatctgtcttcttctgagccctccaaactcatccaacttctgtctgttacccaatttcaaagcagcttctacattttcaagtatcttgacagcaaagccccacttcttggtaacaattttctgtactaggccactctcgcattgctatcaagaaatacctgagactgagtaatttataaagaaaagacgcttaattggctcacagttctacaggctgtacaggaaatatgatgctggcatctgctcagctgctggggaggcctcaggaaacttacaattatggcagaaggtgaaggaggaacaggtacatcacatggccacagcaggagcaagagtgagagggagggtgccacgcttttaaacaaccagatcttgcaagaatttactcactattgcaaggacagtagcaaccaattatgaaaaatttgcccccatgatccaatgagctcccactaggccctacctcaaacactgcagattactacaattcaacgtgagatttgagcaggcacacatgtccaaactatatcaactcaagaacctaagaaatctacctggtgctctattctactgtggctaagctggcaccccacccaaaagataaagtccttccctctcttctctcccctttccacaaacagagatgtctctcctcatggccacgacgactactgaaccaaagagagtactgtctgaggtccaatgttcactcaagggccaaggccactttggccagcctgtggtgaatgctgtcagtcctgagtctctcccttcagggcagtaagaaaatggaatccaggagccaaactctggaatcagggaccctaggagcccacttgatgctctgccccactgtggtcaaactggaacccaagctgcaagccaaagtcccctttactctcacctctcctttcctgaagcagaaggattctctccctgtagccaccacagctgggaatgtactgggtcacacctgaaaccatcacagctctgagtctcacccaatacccacagcaagtactgcctggctacagctgctgattattcagggccctaggtccctttggtcagcatgtcatgaattctgccaggacggggtccttctcttcaaggtgacaggctctcttctggcccagggtgtgttcagaaatgttatctgtgagctagggcctggaatggggacctcaagactctgcctggtgccctatcctattgtatgtctgagctggtatccaagcagcaagacaaagttctctttcttgtctcctctcttcttcataagcggaaggaaggagtctttcctggagctgtgagctgtgctgcctggggttgggggaagggaagcacaagcagtcccttagctgccccagcggatgtctcactaggttgtatgtatcccaagtccactgactctgagcccggcacagcaccaggacttgcaaaggaactgcagtccttgtggcctagactacctttgaagtttatttagaaccacagagcactctaatccatgatgacaaggcttgccggaactcaggttccaaacactgggatggatgattcttccctgtctagggttcatctaaatgctccctctgcgggatttggctgagttctgttctttgtcggtttccactgtgacagggcagcactgattttcaatgcaaagtcctataatcactgcaatctcccttctgcaagcacatagactctctcttcatgccatgtgactgctgccatggatgagggagagctggtataggtgatagaatattgcctttactaccctcttctgtgcctctttctgtgatacaacccaaaaaccaggtactacgatcatgcacctaatttttcactcttatgaaggtgcttttctagtgtggacagttgttcaatttgatgttcctgcaacagggataattactggaggcttctgtttggcgatttttctccacctcctccacaataaacttcgagactcattttccctcaaatatatggtgaccatataaaatgactagatatttttaaaatgtatggtgtatcattaaatataggaatcagaaatcatgatatattataatccaagaaatggcaaacatgttttaatatagaaaagcaacattcatttaaaagaaaagcttgagtagtgcatgtacaaacatatgcacatagttttttgttgttgttgcatggcaataatgaatggtccataggaagcatattagtatttttcaactcccaagatttataacgtttatcaaagttcaataagtggcctgtgaaatataagctttaaagccagaatccaaacagaaccaattaccccctcaaatgtgtaagacttcagctgtcactgttttcactatctcatcacctttaccacaagtacatccatcgctattgtcctctagttctcatgctaactttctgaatgggtaccctcagcatctgtgaagctgtagaaaccctactggcctagtttacctacttgcctcagtaactagatctgctttcctccaaattctggtattccttactagactcagctgcaaagcctgacactgcatggtgtcacggtgtgtataaatcttaggcactaatatagtagtttccattggagaatgaagtgaggcaaggtctgacaaaattatacagtttttatccccctaaaactaatgtgttcattctcctctttacagcaccttctttcccaacacgaagtatgctgacatcttgggctaggaaagaagccaaggagagcatgtcatgtatcattttcaaaaattcccactaattgccatagttattatactgcaccctgcaacctgatcttggaggtcaaactttaaattacaacctcacagtaaatagttcagaaagaacctaatataaagttccccatccaacaactagaaatgaaggaaaatgttccagtttttcacaaaattaaacatgcactaacatttattttcctacttaatggaatgtgagaaatagtattgtttttatactgaattctatgagaaaatcgaaaatgtgtcattgttttcaaatcctgatccatttttgtcctccatccatatagctgaacagtttaattattaatatttttcaactatccgaggcaacattaaagttcaaatgcaaacacatttattttcattttgaaaacataaattcagtttagtaacaataacataaagaagctgcgtggctggatgcaaaagattcttggccaggcgtggtggctcatgcctgtaatcccagcactgaggctgaggaggctaaggcaggtggatcacgaggtcaggaggtcgagaccatcctgaataacatggtgaaaccccgtctctactaaaaatacaaaaagttagccgagcgtggtggcgggcacctgtagtcccaactactggggaggctgaaccaggagaatggcgtgaacccggggggcggagcttgcagtgagccgagatagcgccactgcactccagcctgggagacagggagactctgtctcaaaaaaaaaagaaaaagaaaaagaaaaagattcttgtggcaaatacattatggcaaccctcaaatcaatcttcctgattaaatgcttttaaagaaaataaagaaattggcagatgtcatcaggagccaaggacaaatatgaatatatcacgtttggaagactgtttaaattatctctagtaagaataggtaatgttgacactctgaaattctattcatttatgtggaaatagaagctcactctcaacttcaaaaattttgccactacatagcatctggcacagtgcctggcacatactacacactcaataaatatttcttcaatgtataagtagtataacttaattatgaacaagacatagttttgatatttctgattgggaatttttgtactaagattaaaatgtcaacttctattaaatctgctctctgagatagtctattagtttaatttgaattgttccaacccctggctgttacccagttccaaagtcacttccacgtgttcgggtatctttatagcagcaccccactctctgcggtaccaatgtactgtactagtctgttctcacgctgctaattaaagacataatagagactggataatttataaagaaaacaagtttaattgactcacagttcggcatggctggggaggcctcagaaaaaatcatgatggaaggggaagcaaacatgtccttcttcacatggcagcaggaagaagggccaagcaaaaggggaaaggccccttataaaaccatcagatcttgtgagaactcactcactatcatgagaacagcatgagggttacactcccatgattcaattaccttccaccaggtccctcccacaacacatggggattatgagaactacaattcaagatgagccaaaccatatcagcattatttatctttgtgagaaagcattgtttttgaagatacggctctctcatttctgtgaattccagaaatttagctttcctgtaatttaaactatgagtcacatgcattgtattattagtacaagagatgtccacatttagctgcattatcacatttttaattattgacagaaaaattattatgaccataatccatgtgcaacctaaccgaatgtcacgttatcatctataaataattcctacttcttattagtccaatagcttaattatcaatactcatcaacactcatatattgtctgttatatattattgcaccagaatcttgctactgcttaatcacccatggggtatgatatcaacatatgaggactgaatgaaatatcagcaccatttttagagctcctgagaaagtaattaaaatatttggcccacgtcacttgatagaaaaataggaacagaagatatctaagtagaggtttacaaagaagttgagatttctactctgtcttaatttcagttagatcagtgcttctcaaacttaaactgatcagggatcacctgggatattgctaaactgcacaattctgattctgtatatatcagaatgagagctgagagtctgcatttttaacaagttctcaggtgacgctgatgctactggtcctacaccaccttgatctgcaagttactattgcttaacattactggaagaagtaaaacagaaaaatcaatgaacttaccaaattgtgaaataaaatcacaattaggagtttgagattgtgcacctccaaagtatttactgcaacgaattcaattccaagattggaattacctgaataacttaatttagttgttcatctattcattcatatattcacatacgcaaacttcactgcacttgggagaaaataacccactcatttgttcagcacctccttttctctatccactctcacatatgccatcttatttccagagtcaaatagacacttgggggaaaaaaaaagagatgagccatatttgttagatgtatttttctgtccagtcaaagcattgatggtgattcacaattattttccatattatggcttgtgtatctacccagatactattcatatctctcctcctgctgatataaaccaaaaaacacaacttcacttggcctcctgacttgctttcatttttttcccttaccgtcacagaagttttagtttctgcctgcatgtcctaactacaattatcagaaaagttgatggaacttgctgtgcttaactttgagtccttataaaaatgtcagtaaatcttttttgctctctgcaggttgcatttttcaatcaaattaattagtttattcatagagaagaaaatcttctgttttccctgtgccagttgtcttcttgcacttccacagttggaagttgtgtgtttttcttccgaattccttacctcctaccatcccaagtgtattccacagcattaaaaaaaaaatcattggcttactcctcttaaggggttctaacaaaaccacatcaatattctcttgttttaaacactacattatgaaaggaatggcacttagttttctcatttaaatcatataaacattggtaaagttttgtaattgaccagtatcggcacgtgccaaactcatttgtgactggagatgtgttaataaacttctttattgtattagcttttacctcatcagaaatttatgtccataaaagcaacagaattggagggaaaatacaatagcaaggaaagaatcaaatgagagtgtggttatgaaggagaaagaaaggaggaagtatctgtatggttatctttcctgacattcctttgtaagcatatttttaaatgttgccattgtgaaaaaataactgcaaatgtatttctaatcatcctgctcatgctcccttatccccatacaaaataaccacagctatactctttgggaaaaaaaaatgactgaggcaattagaaaaggctggagaaaaaaagtaaaaaacatctatgagggtcaggtttggtagctcaggtctgtaatactagtactttgggaggccaaggtgggagaggatcacttgaggccaggagcttgagactagcctgggaaacataacaagacctcattccctgcaaaatttttttaaaagttaaaaaattatatataagttattatacaaaatatatgaaatataattatatataaaattatataatacttcatatagaaaatatcaaattacatataaaaagtgacatggtatggtaaaatagttaactgacagctcatcatcttatttatcacagttatctttcttcacattttataataattttgcattcacaaactaactttttataccctatctcatctagtatctttcagaggtatgtcagcctcatgacactattgctgttttacaaaactataaagtagagaacagaaaagaaaagtatattgccccagttcacataaataagtgtttgagaaagcaagcccttattccttaggcaaactggagaggattttatgtaaggcagaaatcagggcacgctattatctttgtatttttaatatttcttgttttgcataattgttgatggtttatgggataaatattatttcctagatgcaacttgaataatagtaactgtgggcacaaattgaagcagtctatttccaaaggaaaaagcacttttactgtcaaaaggaaaaaaaaataggaactaaaactaaacagagaagtggtttttaaaataactaaatggctaagatagtaaagtatacttttatcacaactaccagctggtctaagacactactgtgtcttaactggccaacttcactggcctaataactgtcctctcttcctccagtggccttcctgataggttttcttgacctatctctcacctacataaaatctgatggctttgtcttgcacttagtctagaattcaaagcccttattcaaagccctgactgacactacaatatgtaatcagtctcctacctatatttcaaccccatctcagacctcagccatctaacttaccaccctgcaactctacagtccccctggccttttggttcctccagcaagccaaactgtccctatttttgggcctttgcattagctgttcctaatccgtgaaccacacttccttgtgatctgcaaatagtggtaccttcttgtcattcaaatctcaaactaaatggtaccaaccttcaaagtcttacctggatcacaaagtctaaagtagcctcccctcaaccattctctatcacattacattttaatctcttcaaaaactatattcctatccggtatttttcttgtgttcttttttttcttggctgccagcctctacagaatatgtttcatgagatctggggccagaccttgtatgatcattattgagtctccagtgccattaattgtttttgataatgtattccattaatatttgttcatatagagagatatatgtgtattttatacgtatatatatatatatatatatatatatatctcacaatgactatatatcaaatataatttgatgttgctattaggttggtacaaaagtaattacagtttttcccattacttacaatggaaaaaaacatgattacttttgcagcaacctaatagtaagtatgttggtagataggattaataattgctaagtgtaaatgttcatagattttagtgataagcttatctgtatttacaagaagtttttaacttttgttatatcaacttagaaattatagcatagctttggatatacttaatatgactagacaaatgttaattatcatttctctaatcgctaaaccaaggcttaggcaggaaataatggcttccgactggatctatccaaaccctgtcttaggtagagagagaaaagaagtatcgatgaatccatttttgtttactagtaatcttctactctgaagtaatcatatatttagaaaaaaaataggtaatgctccaagttgaagctaatcattggagataatccattctcatgaccatgataatggaaactgaacaggttataatttatttgaagcattaagtaaaacctagattagttttttaaaaataatgacaataccctcttttcataatcacgttttttgtttcctctcacaaaatctttcaaaaatcaggttcagcaaagcttacataatggcttatcacattagaatttaataggttttatgcacgaacacatacatagtcaaagtggcaaggaagactgttatttataaactctcatattatttctgaatttgtgttgctcaaataatgctttgtatattcatttttaaggaattttccagaaaagtctatgtgatagaagtggttacatgtacgtgtctcattttaaaaactctgtgagatgttttagcaaaagctataccagctagaaggctctccttgccttcttaataattattctaaaagctgtaacacgtacaaaagctcttgaatcttccctaaggacaaactaattttttatgtcaatctcagctaggtggtaatactgccattttagcatttccattctctagtgggatggggatgaggaaattacacgcacagaagtctaggtgtctgtcatccttcacttaatggcagacatcccttgaaggggggaatttttgaatgaacatctttttaaatgttagaatcacagataaaagactttttttatgtttcagataagcaaagaaaaagttgcaattttaattccaggaggaattcatattttcttgcaactcaatttcacacagcaattaattaactgattagtatgaataattaatgccatattgttagttttattgaaaatggggagtgtaagaaaaatgagagcatttagcctccaggagaggatggaaacctagagtgcacaaaggagaagacactggtggctattatggcaaggacagtaaagaggtggttggattttcaaaactttctaattttgtttgaggttgctttaagttccacagatcactgcaaatagaagttctaacctgaagaatgttggcatatgaccacagaaggcagcttatatcttaatatcgataatagatggagtaaattagtggacctggtaaacactggggagtgggcagactcaacagttataatatgattattgtacctctcacatctaggggtagtgacaatcatcaccacgatcacagcaggcgaataatatcaatatgcatagattagtatctcctggcttggaatacatatatagttatgaaacctctatcttacatgtaccttatttattctttcaaaaggcctgagcttaaaaatgtgtttttcccctccataatttcacactataatttagtactggaataccaatccttctagcatatctaatgagtttccttggtccttttttttttttaacgcttttgaacttcataaataatagttaaataaacttaaggcatttggacaatttttttcacttaatgtattcaaatccacagttggcacttcatttcttttcatttaaaaataaatctatcttgtcttgataggctttacatgaatatacacacctaacaatataaatcaaaacacatatccagaatgatgagatctgcttgttacctttataagaaatatgtcatttttcagaaatgtctcaaatcctcttttttattaagtcaatatatattcttaagataattcatagccatactgtattttaataagaatttcccaaaacgtttgaataatgtttttcaagaggatttccatatatagatgagtaactctttaatattttcaagggctttttcttcagaagagaagtttcgtgtcaactatagctaataggtgattttatgtacacaatctcctgtgcatgcttctgtgccttttatagtgacattttaatgtttggaggaaaacctagaaaataataactatgacagaattttggcaaatcttaaaacatagttctgtagataacagtgcatctatctaacatctgctcttttagttacaaaagtgaaaaccaaaatgttatttctatgaaaatccaaccagtctcccttgaaagaaagctgtgtgccttgggaacaaactgagaatcgtaacttaaccatcaaaccacatcaaaataatcacaagcttccaaaacttgttagtcttcttaattaaaaacaaataaggacttacttgctttgtttttccatgctagctaccctgaggcattcccatcttgaatttaggagattcatctgctcttgtacttcagtttcttcatcttctgataattttcctgttccaatcagcttacttcccaattgtagaatattaccaacccggccctgatgggctgtcaaatccatcatgtacccctgacaaagaaggaagttaacaattgtaattagaactctaggtaaatcggtgtggttttgagttttatttgtttgcagttttaaacttgtggcccatttagatttatattcccagtaaaaggaatttaatttgtatttgcagaatcccaaaaccacttttaatatgaattaaggaaaattatcttaagtcaagttcttcagaagcaggccccgagataaggacttcagtgcaagtgatttattaaggaagagctcccaggaagttccgcaagggagttgaagatggaggaaaaaggacagggaagggaaagaagccaaacgagtgtatcatctcaggaaaagtctcccactgagagaagttaagcccaataccatacatcaactcaggaatgtaagtaatgcctcagcactgccttgacacaagagaaagaagttgggctttcgtattcctgttggccgatcaggtagaaatgccttcaatggttgctctccaaaagaaaacttcaaaatctgactgttggaatcccaagcacatcatagtaactaaatttccaaaatacaaggatgtaagagagtaattgaggaaaaaggatgacttgccattataacaagtcatatgttttgttttgtaaattaacgttttagtttacctcatgagtatgaaactggtctttcaccacttccacatcattagaaatctctccttgtgcttgcaatgtgtcctcagcagaaagaagccacgataatacttcttctaaagctgtttgataacggtccaggtttacttcactctccatcaatgaactgccaaatgacttgtcttcaggagcttccaaatgctgcacaataaaataaattgggtgttacacaattaatgtctttgcagattgttccagtacattaaatgatgaatcgaatgaaatatttaaaatgctaggactgtccactggcattatcaaacacaggaacagcagatacagacaatagggagttttcattttaacttcctcatgcatacatcaattttcaaatagcggtcaaaatccacaccaaattaatattgtattaaagctcttctagattactggaaggagtaaattagtatatcacctcatgttgctttttaaatgctataaatattgatctgtaggaactttcctcatttcttatttataataacttacatatacattatcagaattatatttacatacctctgcaatggcattaaaggaaatatctcttcctgagaggccctaggtaatgaaatatttccaaatatttacagaccagtaaaggcatcagtaagaaaacaaggaggtaggggaaaggaaggcaaaatttagaaagaaaaaaaatacctcacccacccatctaaaatttctaacagcataatgacttctgtgatttagcctttatttccagaaggccacgatttaaatagtaagacattatcttagaagaactaaaatatgaagtatgctttacccaatttaattagcaggatattaagtgagaatgcaaatggttgtcttggaatttccgtctggaccctaaagccaagagcaaagtgtacgaagcatccataattctaaagagaagatccagggtacctgttaaaaaattgctaagaagtgatcacaaaattggtctcacaacccttaatccaatatctagcttaaaggtgtgtaagagcaagcaaggaggtcgattagaaaaatctggtgagaaaggcttcctctggagaggctggagcgctctgcgtggctctaacttctccccatctgaagccaagtaatagagacggggtagtttacatgagctgtaaacctggccatatgtttgcagagatttgcatgctataggaaccatacactcaagtgacaggagaggcttcttgggataaactacatgtctgctgctttaacctaaaggcatttatcaagggcaaaaatttgagtaaactactaagtttgcaggaggttttgctttgggaggagtgtactccttgcaggtcgccgggcttcaaaaatcctgagaacatgctcaagagggactttgctgaggtcaaggacataggcatactatttacggaggtgagcagaacaaacaaatattggagaaatatttgtagaagaatcttctgcattccacaaatattgcaagcaagcacggggccccctaacaaacagggttttgtaaaggaatcaaaaagcagtgtagaacaacagaagctgtttgggggatttcataatctcacccagagaaaattcaacctttggtggctttcccctggtgtgtatgtgctacatttcctgtccttctcagttctgggaattaacccactaagctgccagcaccaacttacttgtgctcttctgataaatgctcaaattttgaaaattcaatattttaaatttccccaactgttaagtccttcgagatgacaaggcatagtggcagttattgcaatgacattttcatcaaatgatgcactctttttccagtttctataaaagtggcagagaaaggtcatcctggtaagtcaaaatcaccgaacttcatcatatcaaagagggtaagtgcactgaaagggctatttgcatggaacccttgtctaacagtaaggcaatttctgaaggtcttaggggttagaacaacttccatggtgtatctcttccgtctctaaatactattaataataactatcaaagtcagcattaagggggaaaatgatataaaggcagcctgagagatgtgcgcaggtggaaccagcttcacgtttgtgcaacctgagcagttgcacagggccctgagcgcagaagaaacacatgcctctattatctgctgatactatcctgaaattgtaaataattttatttttgaatttgtgttttagaagtgaagtcctatgtgcaatgaaggatgcacatgcgcagaggagacaggtggtataatatgtgtatctgtcctatttgcatatagcattttcaatgccctagaagcacagaagtctggtgagctcacagtaagtttagtaagattcaaagaatatggcgtaagtgtgttatgtctataactgagtaaacaaggttgctggcagccctgggagataatgcttcctatctgaaccagaccctgcttcaaatgcagcaagaaggcaattttttcaagaaaatacaaacgaccaagaaaccctatcatatcctttcctactcctgttatgttcctatatgaaccaaccacttatgctgaaattgatgatatagaaagaaagggaatcttgtgactttgggagttacctagccctgcataagccttagtttctgcttctgtaaaatgggaacaataatacttccataataagattgtggtaagaattaaagagtgcataatgcacttcacagagtgaccttgtataacaactaaataaagtatgttacggctgtaattattatcaaattcctctgcatatataagaagtgttttgaagcataaattgccccaagattaccttcttaagtcactgttcaggtttcaggagatggaaaattattgtcgaaaatacgcccccaaaaatgtgtaagagcaaacattatttaactctttttgaaatctgaaccttaacctagctcgtatttaagagttcttaaaaatcattaactatcttgagttcaaataatcttctccaaacgaagcattgtaaacagcactaatactcaagtaacacaatactttacactgtgcaatttgaatcaaaatattaaacactttatgatttattgatatttacacaggattgaattttggaagaaaatattaaaaggtgtatacttatactcaaggacatgacatctagtactcaaattctgaacctaaatattttgtctgaggatgtgcataaaacaaaaacatttcaaagacagccttcttaaagataaattcaaatctgaataagctatgcaaaattttatatttatatccatcaattcaactatatatatacagaattataatcaaaatttgaatttaagatctgagtaattatttgtctagatagactattgtttttcaaattgtaagtcagaatccattcatggttcataaaatcatgttagtaggttatgactaggaatattttaaaattaaacagaaaaatagtagtctgtgtcacttatataatactaacaattattgtctcaatttttgtttcagatgtgcatatgggtttattttgatatgtatatgtatatatgttctaaggtgagattaaacttttttctgcagtttgtaaaacaaaattggaaatggctctagaatttcagactaagcaaaccgacgaaaaaagaaatttgcctgaattctacatttgtatattttccatagagaccttggaataaaagacattttaaaataaaacgatgtttaatctgagaatttggaaataaagatataaaaagtggcttatgctttgtttcagcaccccaaaatatgtttttatcatcacagaattttacattgtacctaagattggagatcacttcatacatgtcatggcatcaaatgaagagattttctaggaaagttggtttttgttctttatagatctatttataagaaagatagaccccaatcgtttcatgaatgaagatgccagtatcatcaactggaactaattatttttcctatgcttcaatcctattttgtctttatcacagtagtttatgtttctcttcagtacattgggcaaataatgattacgatgagaggcatgacagtgaatggatgaaacgattctgtttttgttttttttttttcccccaaaattgagtacactcaaatttattcaacgttatccacagacttcagaggcttaattactgcctgttagatttaggaagtattagatattgtcacctatgttccttgaagacatcgctcattaaaaaaggtggaagaggccgggtgcggtggctcagacctgtaatcccagcactttgggaggctgaggcaggcggatcacgaggtcaggagatcgagaccatcttcgctaacatggttaaaccccgtctctactaaaaatacaaaaaattagccgggcgcggtggcggcgcctgtagtcccagttactcgggaggctgaggtaggaggagaaaggcgtgaacccgggaggcggagcttgcagtgagccgagaaagcgccactgcactccggcctgggcaaaacagcaagactccgtctcttttaaaaaaaaaaaaaaaaaaaaaaaaggtgaaagagcagaaaggagaaaggtaaaaaaatcagggatgataaatgactgttttagtccagcaatgtctagaaaaatctctagacactcatttctggagacaatttctagtcataatttctactcgtagaatttctctgactagaaatggttctaatgaagtatacagcaatagccttgatacttctgaatatataaatatattttaaaatccagtttactatctgtctgatcttgggtatttaacctctctgcatctcagttaccccatctataaaacaagaaaaataaaaatatacgtacgtaaggctgctggaaagattagatgagatagtgcatataaaatgctaagcacattctagatcccaagaaatgctctgcaatgcctgtgtttgggggccaaagttcattgaaatgataaatgatttttatggggaaacaggtgaatgagctctgtgtgtttctggaagcatgatttgggcaattcaaactgagataagtaatcaagtggctacatgtaggtagtgaaaccagcagcccagcaaaccacaaagctcttagaaaaaatagctgggacactatgagagggcacagtctatcactgagcagttttatatcactgataaaatggattttggcaatttatctaaattcagccttaaagtatgatacgactgttaacctggatcaaaaacagttttattggtcttgaatgcataaatgcttcaagaacatttgcaaattttatcattctcagttcatttaaatgtatcatacttctttttcatggagtctaagtcaatgcatggatggtgaattttttggtgtattctataatctttttacccctcagtaaaagattatttccaagataaaggattacagagggataaccaagcggttctttcactaaataacagaagagcatttctgaacaaccaggattagtacctggaaatattcttgacacatttccgctgtgttttctcacagatataacacgtaaaccaaggtactattcaaagcataaaaatgattactgaagtgatttatgagaaattaatccatcatgcaacactgtacatgacattcaacctaatgacactattaaataggtaatttttaatatagatagggcctgaaattgagttcaaagttaagccctaatgaggatttaggaaaaatcatggcctgctgttagggcaacaatcaacaacaaatacaactactaccgcatatacaacagcaataacaacagctgccattatttattgagtacttagtgtcagtcaatttgctaatcacttaacacgcattatatcatttttcactacaacagatcagggtgatagaaattagtaggatgaggaaatggaaatagaaaaattagatgacttgccaaaggtcacaaaggtaactggtggttctgggacttaaaaccaggttgtttggattccaaaacacgtctttatcccaatatgatcaatctctttaaatgaagaaaatgaattaagagtctaagcaacagcacttttaaaaaaatataatataactttttttttttctgtttttttgagattgagtattgctcttcctgcccaggctggagtgcaatggtgggatctcggctcactgcagcctctcccttctgggttcaagccattctcctgcctcagcctcccgagtagctgggattacaggcacaagccaccacaccgggctaatttttatatttttaatagagacagggtttcaacacgttggccaggctggtctcaaactcctgacctcaggtcatccgcccacctcagcctcccaaagtgctgggattacaggtgtgagccacggtgtccggccctcacgtaacttcttaaaaataagtcaaagtgtattttttcttaatttccacaaattcaatcaatggtttggaagctactaggaaaatacctcgtcttcattacgttgctgagtaggaaatcaaatgtcaagtctaaataatgcacgcaagtcacagacactgatatcacactgaggaagataccagaataccagaaagacagcaatgggacacagcccagatggtagtacagacccggtaaatcctccattatccatgatgtccttatttcacactgcatgtctgtatcaaaacatctcatgtaccccataaatacatacacctactacgtagccacaaaaatttaaaacataattttaacagttttttaaaaacataaacagaaaaagaagtcagaagaagctgagcaaaaaataaagctaacaaattctttctaaaagaaggcatgtgtcaagtccaccattcgaactctgcgccttctgttaatccctatgatttgcctttgatgttaaatgtcagcaaatttaacattcttcactattgcagaaccactcacagaaatgctacattgtgcctccgatgctccagttaagaagacaaaaatgggtatcatacgtacacatatggggtattttagtttttaaaaatctcattctatagcctattaaacaaaaggttctagagccaaaaacattaatctttttttttatactttaaatactagggtacatgtgcacaacgttcaggtttgttacatatgtatacatgtgccatgatggtgtgctacacccattaactcgtcatttaacatcaggtatatctcctaatactatccctcccccctccccccaccccactacgggacccagtgtgtgatgttccccttcctgtgtccaagggttctcattgttcaattcccacccatgagtgagaacatgtggtatttggttttttgtccttgcgttagcttgctgagaatgatggtctccagcttcatccatgtccctacaaaggacatgaactcatcctgttttatggctgcatagtatttcatggtgtatatgtgccacattttcttaatccagtctatcatcgatggacatttgggttggttccaagtctttgctattgtgaatagtgccgcaataaacatacgtgtgcatctgtctttatagcagcatgatttttaatcctttgggaatatacccagtaatgggtatattactgtaatgggataaaatgggatggctgggtcaaatggtatttctagttctagatccttgaggaattgcacactctcttccacaatggttgaactagtttacaatcccatcaacagtgtaaaagtgctcttatttctccacatcctctccagcacctgttgtttcctgactttttattgttcaccattctaactatgtgcaatggtatctcattgtggttttgatttgcatttctctgatggccagtgatgatgagcatttttttcatgtgtctgttggctgcatcaatgccttttttgagaagtgtctgttcatatcctttgcccactttttgatagggttgtttttttcttgtaaatttgtttgacttctttgtagattctggatattagccctttgccagatgattagattgtaaaaattttctcccattctgtaggttgcctgttcactatgatggtagtttcttttgctttgcagaagctccttggtttaattagatcccatttgtcaattttgactcttgttgccattgcttttggtgttttggacatgaagtccttacccatgcctatgtcctgaaaggtattgcctaggttttcttctaggtttttatggttttaggtctaacatttaagtctttgatccatcttgaattcatttttgtataatgtgtaaggaagggatccagtttcagctttctacatatggctagccagttttcccagcaccatttattaaatagggaatcctttccccattgcttgtttttctcaggtttgtcaaagatcagatagtagtagatatgtggcattatttctgagggctttgttctgttccattggtctatatctctattctgataccagtaccatgctgttttggttactgtagccttgtagtatagtttaaaatcaggtagtgtgatacctccagctttgttcttttggcttaggattgacctggcaatgtgggctcttttttggttccatatgaactttaaagtagttttttccaattccgtgtagaaagtcattggtagcttgatggggatggcattgaatctataaattaccttgggcagtatggccattttcacaatattgattcttcctatccatgagcatagaatgttcttccatttgtttgtgtcctcttgtattttggtgagcagtggtttgtagttctccttgaagaggtccttcacatcccttgcaagttggattcctaggtattttattctctttgaagcaattgtgaatggagttcactcatgatttgcctctgtctgttattggtgtataagaatgcttgtgatttttgcacattgatttgtatcctgagactttgctgaagttgcttatcagcttaagtagattttgggctgagacaatggggttttctagatatacaatcatgtcatctgcaaacagggacaatttgacttcctcttttcctaattgaataccctttatttccttcttctgcctgattgccctggccggaacttccaacactatgttgaataggagtggtgagagagggcatccctgtcttgtgccagttttcaaagggaatgcttccagtttttgcccattcaatatgatagtggctgtgggtttgtcatacatagctcttattattttaagatacgtcccatcaatacctaatttattgagagtttttagcatgaaggttgttgaattttgtcaaaggccttttctgcatctatggagataatcatgtggtttctatctttggttctgtttatatgctgcattatatttattgatttgtgtgtgttgaaccagccctgcatcccagggatgaagcccacttgataatggtggataagctttttgatgtgctgctggattcggattgccagtattttattgaggatttttgcatcaatgttcatcaaggatattggtctaaaattctcttttttttgttttgtctctgccaggctttggtatcaggatgatgcttgcctcataaaatgagttagggaggattccctctttttctattcattggaatagtttcagaaggaatggtaccagctcttccttgtacctctggtagaattcggctgtgaatccatctggtcctggactttttttggttggtaggctattaattattgcctcaatttcagagcctgttattggtctattcagggattcaacttcctggtttagtcttgggagggtgtatgtgtccacgaatttatccattccttctagattttctagtttatttgcgtagaggtgtttacagttttctctgatggtagtttgaatttctgtgggatcggtggtgatatcccctttattattttttattgcatctatttgattcttctctcttttcttattagtcttgctagcgatctatcaattttgttgatcataaccagctcctagattcattgattttttaaagggctttttgtgtctctatttccttcagttgggctctgatcttagttatttcttgccttctgctagcttttgaatgtgtttgctcttgcttctctagttcttttaattgttatgttagggtgtcaattttagatctttcctgctttctcttgtgggcattcagtgctataaatttccctctacacactgctttaaatgtgtcccacagattctggtatgttgtgtctttgttctcattggtttcaaagaacatctttatttctgccttcatttcgttatgtacccagtagtcattcagcagcaggttgttcagtttccatgtagttgagtggttttgagtgagtttcttaatccagagttctagtttgattgaactgtggtctgagagacactttgttataatttctgttcttttacatttgctgaggggtgctttaacttccaactatgtggtcaattttggaataagtgtgatgtggtgctgagaagaatgtataatctgttgattaggggtggagagttctgtagatgtctatgaggtccgcttgttgcagagctgagttcaattcttggatatccttgttgacattctgtctcactgatctgtctaatgttgtcagtggggtgttaaagtctcccattattaacgtgtgggagtctaagtctctttgtaggtctataaggacttgctttatgaatctgggtgctcctgaattgggtgcatatatatttaggatagttagctcttcttgttgaattgatccctttaccattatgtaatggccttctttgtctcttttgatctttgttggtctaaagtctgttttatcagacactaggattgcaacccctgcctttttttgaaaaacattaatcttaattcctacattaaaaaaatggctctggcaaagattgctcatcctccaatatgtatctttcttcaccctttatgtagtattagaaagtttaggggacaatttggctatctagaaatgtcactacagttcccactttcccttgcagttagatgtggcatgtaaccaagtattggccagttggatataacgcatccaacttcgtcattaagacgtaaatgggcatagatatgctctcttcttcgtcctccctcctgaaggtcgtgatacacacatgaagctggtgagctatcctcaaccgtgactacgaagacagcgtcccaggggatgatcgaaaaactgggcaacaggactatggatccctgaatgagcagagacttcctacaaggcctccatcactcccatctacacaacatttaagagaagtaagtctgaaagagaaacaaactcattttttagttcatccatccttgtgtttttgttagtgccacgaaacctacagcaatctcatatactgatatactctaattttctagcagctgagattttactataaaaatgtatctgtaaaagcttatatgtgagtttaaaataaactttctactataaaatcagatgtctctctaaaactctactctgtctctctaaaacatactctcaatgaaggttccagtcattttgcttcatcgtttttcaagtcacatacctttagatattacactaacccttgcattgtaggaaggcggggacactgaccccgtgcctaacagcacagtacacagataataaatatttactaaattgtttggggtaattttaatttcttatttaaggtcatttgtgcttccaatttcaggttttatataaaatatgttttaaccaatcaataccttgaaaatggagtaatatggcataaaatattcatagtttcaaatatatgtcttcccaatattcctattcatatttcatatgtgtttatacatatatacatattcacatacatatatagtataccaacttatatgtgtgtgtgtgtgtgtgtgtgtgtgtgttttcttcctctaatttctctaattctaccatttatatctttgggtatacatttactttctaacttattttatattttattcctttattttttcctgtacttcacctgagactttctgtcttggctattataatccacacaatagaacctttctcataaaatcaagaaggaagaaaaagaaataagcactgttatggcaaattctcctaaatcaatggaaggtcagagagaaaataatagaagatttagagaaatgtacctagaacaatttaataacccaatataaaagatttctttttaaaagcaagtttataataaaattttcataagcatcaataaaaaaactttctcagaaatttattagatggcacatgaaagacgtctagcctagtgatttctttgttcttactgtttcatataattcttacaaacaccctaaaaggggggacctatttccaagatgaggatgaggaaatccaagtcacacctatgaggtgtgggaggaaaaatgggatacccagtaaacaaaccgacattccttggctgacagagattcatgaagtccagagaagaaggatgaacataataactctgtactgtttggtggatgtttcaataattttaaaagtcagtatttggttggaattcatatgagttggtaattgaaacgagattttgtaaaagtactaaatttaatttaaaataggatagttacaaaatgtctcagaagaccaaataaattcttaatgttattttccttaatcctaagtttaacaattttattaattttcaaatacgtctcatggaaaaacaccaagtcttatttattttaatcagtcatttataaataggaaaaaaatgattcactggatacttttaaaatgcaaaataattcagaagtaaactgctttagacaagtggtttttacataccaaaaaaatcaaaacaaaatacacatatctcgtgaaaacttattatttcaaattgacatatactgcacttaaataatattcctctagaatgaccgtagtccatagagtttgtaattgcatatacaaattaattgtgagctatgaggagaacctaaacataaatattcccatgtagcccgttttggaattttgctttttttctcatcatttataatattcttagctatgtactcatttattccacaagtctatatgtaaagaaattagaagttagcacaagagatgtccccaaaatatagaaacttatctacacttacactaatttcagtgaaaatcttattcttcctgttatttgatccaagactccttaaccttaagcttttttctgtaaagggctagataataggtatcttcaattttgcagaccactaaagaccagatgcccccaactcagctctgtcactgcaaattgtagccccaaagcatctggagacaatacattaagtgaataaacatggatgtgttccaataaaactttatttacaaaaatcaggtagcaagtctattttcaccctcaggccatagattgctatctcctgatgatgaaattgcttcccacatttaaactaatttctctgaacttctcactgttgattatctttcctctctccaatctctccccctccaattgattctcattgggtcactttcccactctattgcatgtccaagctagccatctctgaaatctcactgccctccccctgccctacctccattgctgtatataacaatgtctcaaagaaatcatgctgcataaaaccagtggccgcattcgggaaactttaagtcggcctcactttggagtaaaataaacatgaggtcaaattcaggttctggaatttataggtagtgtgtacttgaacttggcaaagttttttaatttcacactcttggtacacacctgaaaatagatatgatactaatttagagggtaattgtaaggctcacagacaacatacagcgattgtattgacattcagcatcaccctttgccattcaacttttataaaatcactttcactgcctcattgtttttatttagtgcaacccagaatagagaactaacaacaataaagaggagtttggttcaattagattttaggttgtaaaaatattctactaaattgacacatcttttctaactaggtaaattttctccaaggacattagctatattcacctccttaacatacaccagttgcttggtttatcccgttacctttcacatatatcactaaattctgtgtgctttctctttatttatgttacatacctttgtctcttttccttattccttaaacaaagatgtggtatatccttcataagggagagaaatccctatgggggaactaatgggtagcttcctgtctctacttcttgggcatctatagtgcttctgtgggatagtttcattattaaaattagggaaataatataaataactagtgagctaattaggaagacaattataagggtgtgattgtggaaatggggaagttcttttatgagaggtgatgtagcatctcggaagcctcacgacagtagacagtttattttgttcagcacctgacatacagtataacatactatatgtttgttgaatacaataatgtgtctcttagcatatgacatgtaacaatattccattttaccttatactgatatgaggacattttttttcctaagagaattagaccaaggcatctttccatgacagagcagggacaagaaatgacacaaactccacttgtttatttcacttactgccttcttcaatgcagtgttggcttccctattcaaggaaagagattcttggaatctcttcctattcctttcctattcaaggaaaggtcttcagagcctgccatttcaaagaatggtattaattcttgggaagactctggtagatttcattaacacctgcaaattccaccctctgcctcaaggaaagtaataaaagtcctctatcctgttggctgaaagcagtggaaagttcttcaattttatcattggctcctaataggagtaatcatgcttcagggtctgtatctctgtgtcccatagacaactaaagcttttgatcttagggttcatagaactgagaagaacgcagtaagtcttttgcatttcagaaaaataaaagtatgaaaccttttgataagtttccatctcttgttatactaacattacttctcatattttcaagtaaaaaaaaaactcaaaatcagggtgggctaagtgataagagcaatcacttctgatttggtgaagatactagaagaggattaaaggatatgtacagatatgtgtatattaccaactgaggaaatggaagcatgagcagaaaagcgaaacagaaccctaagtgaggtgaacatagaaagtaaacgtcctaaagtcataaacagagacaaaacctcactgaaagttttcacttataatatttttaaacagatttgacatttctttccatttattttctgtaggtatagaatattttataactgacctatttataatgggactaccaccaaatatccatttttaaaatgctctctccatagcatgaatgtcttataaaatctagtctctttcttaatattgttaatacagaagcttctccttcaaagattgaaggtttttttctgcttttggaaataatttgagaaataacatagtactcacagccacttgccaacctgaaaatgttcagcatttatgtaacacttgaccttttcaaaaataaagtacataactcaatcttttcaactactttgccatgagatgtccagaacatttctgtgtagtaaaatagatttcctaggttactctgattttgctgacaaagattttaagtattctactacttaagataacataatctataaacacactttagtgttcatagacatagcagcacatcaagagcaccaaaaacgctaataaataagagagaggcctgacattatgcatcctattaaggatctctgattttccacagaagatatcaagtaccatatattacatcaaattatctgaaaacctgtatattaaaaattggtaaagtttatttctttcttaattcttaaataagcctgtgaagagacattataatatgtccttctagaaccccagttcatcgtgtgtatctcctaagtgggtgctatccactgtgtagactgtgctttaaattataatgctgtcttcatcatctaaattcttttagaatttaccaccagaactgaagtatagtgaattaagtgtttaccatttgtgagggatggtgtaagcactccactaaatcatctaatttaacctcacaacataagggatgattattgtctacattttactatgaggagacctgattcataaaggttagaaacttgcccaaggtcgaagagctaataaaaagcagagatgggaactgaattcagtatctgtctcacgaaatcctgaatattaacttgttgccagacttttttgtaataactcaaggggaagaaacatttcccagagatagctagatttataaaatttaatttaaaaatcaaaatataataatgtgttatattttatgtgaatgtgatcattctaagtctctcatacactcacagaattgtggatagatttctttgattcatccagtctttttcacccttagaaatttctgtgaccaattttatatgtttataatatgattgtatatggcatataatttttgcattctaaacagatagcttgtctatataaaaataaaaaatgaactaccataagtttcattagcacaatgccttaaaatttactcacattttaaattttaaatcagtacataaaatatagatacaatgaaatatgcagcaaatattactgggattttgttggtatataatcatacccgaaacctgtcaaaacttaaaacacacccattggtacatttcaacttatttgttctactttggaaagcagaaatggaaagaaacagaataaacagaaatacctttttgtcacatagtgagataatcaatactatgtttaaaaacaaagtttctttatattttcaaaatagcctctagtggaatcagctaccatattcttgatttgcataatacttataaatttcctacaaactcagtacatattctatttggaagtttttatatataggctttatattacactaaaaaggtcatcaaattattgccacgtccataaattaaaatatgttaaactccaaatatgaaagtacggcagctcttcaaaaaccttaacataaaggtaaattaaaattatgcaaattgagtagaaaactcatgcagaaactgtaaatctggaatagggaagccatttaaggtaaaagagaaatcgtcacaagtatgcttagaatttcctgatttagaaatagtgggacaaaatacaatcctacctatcaagcttttcagataataacattgtgcctaggcctgaaagtacatgcatgacatttgtttgaaaggattgtgattgccttgtaaacttcttttacaaatttattaacacgggttgttccgtatagttggccaacattgcttatttcttccactgccctacaacaaccataaactcccaattattctgggagtagtttatcagagtacagattatctggaggtgttatttctctttcatttggcctttcacagctcattagtacctcaacaagaaagttaaggcaaaggatggaaaggctgcagaatttctaaacaaataaatttgctccttgtcagcagcatatacagaacagcatttagagatatcacacaaaataactaaaatgggataaacaaagatatttaatgtatactgtggcaattttccttgagtgatttttccctctgtactgtcaaaaatattgactgaattgactgtaggttttggcatccaacagacctcaaagtcctttgtttttagcatgtaattgaccatctttagcgatatcacctgccattgagtaatgcattacatttgttgccaatatattgactatttttcaatgtgaagacaaaaactgaaaaccaaatttgcaaaggaagattgatgataatcttgagtggagtctactagaaagcttgtttgattttaggcttgccaatgcattcgatgccatcagcacagggatatctatccttgccttgaggagaaataagggaatcagaaaattaaggctcttttagtatctactcattagaggtgatatatccttaatcatgaaaataataatgtgttatatccattattattttgctttttaataagaatgtaagatatccataatcaattggtaaacttatctttgtctagcctatctactggcaattgaacaaataataaaaaaacttcaaatagataattttttacaaaattattttaattacagacttgccaggtagaagagcaactaacaaaagagcctttatacattcaatacatcataacttcatttattttatagagaagagcttgaaaatcatatggaattctggctctgtcacttagtacaaatagtgttgctttaacaaatatttattaagcaactacaaaggaccaggcactattttaggcaatgatgatatagccatatacaaaacagacagaaatctaagttctcattcagtgaatcatgtcactgaaggcatgctaatcaagagaaataagtaaaatagaaggatgtaagtgttatggagaaaaggaagcaaggaaggggaattgaaagtactagggaaaatatcattgagaaaaagatttaaagatatgagagagtaagtcatgtgagtatgtggaggaaatgtgttccaggtagaggcatctatgactgcggtggaatgagagacggtaacaacggtggaaaaggaagccagagaagaaacatagagaaaggaggaggtgattgtgcatgggcttataaaacagcaggactgcattttactgaatgtctggcaaggcatgggaaggttttcagcagaagagtgatgtgatttgccttacgttttaacaagaccatctggcagacaaaatggattacaggtaaggcaaggccaaagcaggcaggcttgtttaaaaggctatttcactaatttagaccagaggtgatggtggtggccatgtaagtagtcagaagtgatcagattctggatatatacctggttaaggtggacctggcataggtttttttttttttttttttttgagatggagtctcgctctgtcacccaggctggagtgcagtagcgcgatatccgctcactacaagctccgcctcccgggttcacgccattctcctgcctcagcctcccgagtagctgggactacaggcacctgccaccacggccggcaaattttttgtatttttagtagagacggggtttcaccgtgttagccaggatggtctcgatctcctgacctcgtgatccgcccgcctcggcctctcaaagtgctgggattacaggcgtgagccaccgcatccggccaaacctggcatagttttctaatcaacaacatcaggtgtgagaaagaacaagactaagtttgactcaaagatgttcatttggggcaactggaaggctatagtgaaaccttactgacacaggaaaaactattgacgaagcagatgtgggtgttagtaaatttagttttacatagggtaaatttgaattgactaggaatgtataaaaagttgtgtatctaagtttggagtttggcagaaagctctgagctgggggtaaacattgggaggcatcaacttacagacagtatttgatgccaggaggctagataagatcatcgagaaaatgaatgtggtctaagaaccaacccctggttactgtcatatcaggaatttgtgttgatggggaagaaccagcaaattaaaatcaaagcagatgctagaaaaacaggaagaaaacctggaatgtgtggtgccttagaaatcaaagaggggaaagtaaatgcatgtctcaaatcctcctacatttacttaagttacttaatttaggtagtacatataaggaatctcacattgtggctagcatactgtaaaaacttaataaatgtttgttgaacaaattatgtgtcatttcataacccaaccaacatatatcaggatactggttgtgatatatgcagaatacatttggcaattgagtgttaccaatatattatcaaacatgctagagaagtgtagtgtaccgagaattaagaatatgggctgtggaatcaaaatatctagactcaaattcttttctgtaccactgaaccttagtgttctcgtctgaaaatgggaataacaagaatataaactcctaatgttggtaagctaagttaaacatgttaataatatacatacagcatggaagaacctggtcttcagtaaatcctcaacaaattttgttattgtgccaattaaggcacacttaagaagcaatgtcttatgtattcaattaatactaaaatgagcacatattgtggattcatgtatcaactatgtattaatcactcacttagatcacaatggatataaagaataaaagagctgccctcaaggaaatcatagtccagtggaggaaacctacaagtaagcaaaaaatatatgtgctctcataagaacacgtccaagaagaaatggaagcattgaaaagggaagcgaaatatgaactgagaagtaggaatttttacacactactaagaccttgtcaagttagtgtcttcccttatggcgccatgtctaatacactcagcgttgtttcatcaacgtgttttcccggtaatcttttgggggaattgacagtcaaaccatgaacattggtactacatttatatttatgaaagatcattctggatgcagtgtggagaatgatctatggaagatgagggcagcaagaccagttagatatccagtgaatgacagtatgtaatagtcagaacctgactgctgccataagaactcaagaactgttgaaaaaatgaattgatgagatatatactgaggacttcaacaaaacagaagtagggaaagagggggagatgacagacttctgacatatatgatcttagagtgtattggacgtgggcactataaatatgacaaggacagtacagttgttgagaatgattcctaggtgtctttttttattattatacttcaagttctgggatacatgtgcagaacgtgcaggtttgttacataaatatacatgtgctatagtggtttgctgcacccatcaacccgtcatccaggttttaagccctgcatgcattaggtatttatcctaatgctctccctacccttgccctccactcccagacaggcgatggtgtgtgatgttcccctccctgtgtccatgtgttctcattgttcaactcccacttatgagtgagaacatgcggtatttggttttctgttcctgggttagtttgcttagaatgatggtttccagctccatccatgtccctgcaaaggacaagaactcattctattttatggtcgcatagtattccatgtatatgtgccacattttctttatccagtctatcattgatgggaatggtcaggagttcgagaccagcatggccaacatggtgaaaccctgtctctactaaaataacaaaaattagccaggcgtggtggtgggtgcctgtagtcccatctacttgggaggctgaggaagtagaatcgttgaacctgggaggcaggggtgcagtgagctgaaattgggtcaatgaactctaacctgggcaacagagcaataatctgtctccaaaaaaaaaaaaacagcaagcaaagacaaagcaaggttttgtgaggcaaggaattcaaaaccaccatatgacccaagaatccctccttctgggcatatacacaaaggaaaaaataacacaaccttgtaaagatatccgggcttctatgctcattgaagcattgttcacagtagccaagatatggaaacaacgtttaagtatccatggataaatgattaaagacattatggcatatatgcaattgaatattattcagtccttaaaaaaagaatgaaatcttgccatttgctacaacatggatgagcctagaatacattacactaagaatttaaaccttggatgacatcaatgagctctagaactcctcatgcgtagaaatcaccctacatttgactttcagtttatttaacaggtaacaacttctggttattactggcccggaagacgtttgtagtaaacagaagagacaactgtctctgtcctcatggaactcacacttttgtgtgattatacaagcaataaataaataaattatattgaacaaaaaaaagtttgttccaaattatatttgcagccactttatgaataaattgttgagcttagtgctgtgtgacacgataaattggaggattaagaaatgcattaagcaacaccaacaagggagtacaaatattatatttaaccatcatatttcattggaccttaagtgccattcttctagttttatggaggaaatgtattaggacatgataatcatctaatactgcactaaatattgtagtttactgttactgaaagcataagatggaaatcctaggggtcaacattatgtgacagaaaagatcacatgtataatatttgtcttttctacattttgtctatttgacactgggtcggctacaccttcgcttaaaagttctcaccattctctgcttttgtgttttttttttttttttttccagttttctactcaagtcagataatggtaaatctaattgcatcttgatgagctacttaaaaatacccttaaggctgggcactgtggctcatgcctgtaatcccagcactttgggaggccgaggcgggcggatcacctaaggtcaggagttcaagaccagcctggccaacatagcaaaaccttgtcactatttaaaaaaaaaaaaatacaaaaattagtcgggcatggtggcaggtgcctgtaatcccagctactagtgaggctaaggcagaagaatcgcttgagcccaggaggcggaggttgcagtgagccgagattgtgccactgcatgccagcctggcgacagagggagactccatctcgggaaaaaaaaaaaagtacacttaaatgacatacatttcatctcagagcctaagtataatttgaagcatttcaaattgctggcccatttgcttatcaaatcttgttatatttttgaatcacatttcattgttaaacaccctcagtgtatacactcatatgtccctatgcctatcaactttgtggactgagacaagaatattttttttacctcaagtgtaagaatgtaatcactatcaaaactcagactatttactgatgtttttctaaatggaatagtctgttgcattattcagtcatgagaaatcatgtttttgacagggcttgtttctcaagttggcttaaaaggttccttcgcatctctgcattattcacacattgctgtagaaggtgctaaaaacttggcatcaggagacagagtcctactgatcagcaggttatcatatgaatagtggaattccagcagcaagtgttttaaaacaaaatgccgcctgatacttattttatcatgttttataaaatcaaatcatgttaaactgttccagtgatgtcatggtctctgctctcttccctatgccatcttgctctctgataaaacttgaacttgaaagattttttttttttaatgaagggaggaaaatacagagactacggcattgaagagaattaagtaggaatcaatactaataataatcacttactaaaaatgggagtatgttagttaaatactaatgggattaaaacttcttatcgaagctgtatgctgaatgttcattacatttttctggacatttttgtcctgaaaaatcaacatttataggttgataccacatattttatatagcacattgtatgttatacacaggaatttacggtgtactgtagattcctaccacagagtgtatcatcaaaattaggagtttatcagaactcttaattctctcccaatctgaaatattaacatcattcttctatgaactatcccatctcctccttactttcatcactgaacctcagaattgattaaactttcctccttccagtttcccataatcagccgtaattctatgtattatttcttgttttccacacttatacttaaaaatccctctcacagcacacaagtatacttctaaaacagtagatccagttgcccttcccctacctgcatcctcctcaattcatttgcagcactgtttaacataactaccttctttaaagtctttttaaatatctgttatgtgatggtactttcctaaggaaactcttaaatcgtacctaactatgtctcccacctctagttccctacagatagatagatcgatcaacaaaacaatcaatcaaatattctgtccttgaacctcttcaaatttgattgtactttttttctctgtgaaatttcatgtactttttgggattactctgttatctctctccaccctagcccctgcaatgcgattctatcactggtcttaactgatctgttgataataaaccctgatttccaaatacagttagcttattctggaggcaaccttgacactttcaactcagcatggccctttttggttttttttggcaatccttcctaaaggcaaagtgcctctccattcagcttcataagtcccagggttgaaacacatgacttgttattcaaaacctgccaatgcccttctcttgcctactgaataaaatgtatctccttgagcatgatatgcaaaatcctccacaatgtgtccttcaacctcattttccagccgcctctcctactcctcctcccctaaccatatgccctacacacgaaacgaacagtcacaaaatgaactgacgattcgtgcttctttctcatttagctccacaaagtgaagtaatatttctatgggatgatctccttataaaaatcatacttgactatcaaggctcatcattcagttataccttctgctacctgctaagccaagatttatgaagctataatttatggtcccagaggatttatatgaaaagttattatacttcctatctctactgtgtcttaaagcagctgtaagagtgtctgtctcctctctagtgcataaagaacctgaggacaagtcaagtaacacccagtaattaacacaaattagatgatcagtaagtacttgacagattaaattactagtgtttgaccttcacatatgacactattatgtatattttaaaagtatcactgttgattagaaataaattttaacacaaaggccagaagacataacttagaaatcataggtttaggaattcaagatgcctaggtctattttactctgcctcttactagcacaaggacccttcagtaagtcttaatcttaatctgtatagtgggaagcttgattggtggtaaacctcataaatattgccattcaagtaactgccacatgctcctgccatattgtaagtgtacaatgaatgctacctaaattatcataaaacagtcaacagtgataacatgtatatgtgacgatttttgcaaaccttgttctatttggaattttaagaaagtaagcaacatgaaaccactggttgagaagatgtaattatttgtaaacaaagacctttatttttagtaaagattcatcagtgcaacctgtcagaattttctacttcaaatgatttaaaaataaatgattcaaaagtacagtttttttcctgctatggcagtagtgaacactgtactaatttgaacagattctgtgaatgccaaaagcattgtaatgttgacaaatgtgtacttctaaacagtgaggatgtgtgtgtgtgtgtgagtgggagaataatatacatataaagtacattccccagggtttgcttaggttttgatgacctaacccaaagcatcgcaaagatccaccaatatagatgacagtttatgttggaacacaatttaagaatatatactcagctacaagtgggtcggtacaaattgttaatatctcaatgtcaatactactcatgagtaaattaccaccaagataattatacatatatctctcaccttggatctttcagaaatttggcctaggtacttatataatgttctgaataatgtatctctctccattatttagtaaattatgtcagattcataaacatttctcaattaccagacatcaaactgttttcaacaaacttcttattccaattaactataacttcgatttttaaatttatgtacatacacacacacactctgagaaaaagagacagagttcaccaggttcccatttatcttcaaaattgaccctatataaatgttattttaaaacaaaagataaaaccataatcaggatactattattattaacaaatcagattacttggctatttctgcatatattttactctctgataaaaatattataatcattttctgccaaatataatctgcacctctgctaattactcattttccattaaaatgtaaaagtcaataaaacttatttagaaaaatggaaaatcatacatcaggttgacctgggaggctcccctattcttgtcctttacaaagtaatctaaccagataaagagcttcattttattcagcttattaaaccctatggtttgtttctgtaaattctatagtacacatttaagaccagtcatctgtgagaagaaaatgtaataccaccaaatttaaataacaatccaaactatgaaagtagatgcatatactttttatatgcttatgctttatataagctgtatagtatgtaactaactcaagtgggctcatccatcattggtttattgtttctctgaaaaaacacccctcaaggtctttatatgataaaatgaaaaatgacagaaaagaaaaatatgatgatattggaaataagcacattctgaaagccaatttgtcattgttttatgacatatatttatcttcatgtatatgagaacacctagcatagtcctttgcttctaacaggtactcaataaacttttgctaaattttgaatatattagttgtgggacaggtcctaaagtattgctctagaaatatttgattcatcagtaatagcctaacctatgctaaagatgactttgattgatagagggcagtccctttgaaagaaatccaactgaaatgtacagaacataaaaaaaatgcagtggatataaaacacagcattttccaagaaaaaatagagcatattttctggatccaataaaattagacacacacacactttcaaatacacttgcaattcatgatatattttattctattaaggatttatattattaaatcatgggaaaacactgaactctttcaaatactaccataaaataatttccaaactatattccatccttatgaaggaatcttgtggcttgggagcaattaatcacctccccaatcccatgcataagtcctgattgctttaaataaatcctttttgccagggacatagaacaaaaatccaactacaacattttatgctttaacacagtatattaactgtggaaacatgacttaacatgttccaaccagaaggtgtccagagttctgcttgactgagaaaaaaagtacttatttttcctttgacataagcaaagaaaaaaatgttacagttctggcagccatctatcataacaaaactgtatagggaaagaaataactacctggcatagataacggaagagtgaagagccaaaagagccactgagatacggagctgcagtgtgatgacaatgtgaatatttggattaaaggcttaccagaatcctgccattcctttggaattttctgttacataagccaataattcccaaggtttaattacaagaaatctttaatggaagaaaagatgtcacatgttactgctccaatgtggatgttttctgtatgtgtgtgtatgtgtatgtgtgtgcatgtgcgtgtgtgtgtctgcatatttcaagttttcttgagaagagttttccattattgtaccaaacatcattctagtttatatggactttggtatcaggaagtgggttgttgaaagttaatagatcctataatgtggaacaggctgaattatgagaagacaaggatgataaacctcccccaccccaactcaaaatgatacttggtacatgattaaaaaacagttgattaaacaatggtctattttatcctaagtcatgtgccttacgagtaccaacactattaggagatttgatagaaacaaaaatgttgccacctactggcctctttaaaccaagaaagaaaaaacctcatgctaatggttacttgtttttgaagtacagaaaaaaaagaaaatatagctttgtctgaagaagccctctctgcctgtggcttataacgtgaacgccttgagaggctgataatttggagcctgatatgagtggaaaagccaatttgtatttttactccaaatcgaatgtttgtatgaacagagacaggagaggcagaatgtaagacttaagtactaaaaaaaatcaactatagtgcttccctaaagcacttttgtgacaaagtagacgatccctcctatcatgaagaagcagcttctatgtaatctatacttcaaagatatactcaaagattggctatgccctctaccccaaccctgtgctgcaaattttctcagtcaggggattgtgcaaagcacagaggcctcttaaagatgtcaaaagaggttaacatttgaagcctaaaaccaaatcatagaatttgggttactgggtcatggaattgataagaacaaatactgaaagcctataaatagtaaacaaatctgattgccaaagaaaccccaggtctaactaaaaacaccttgttatcactcaaacctagggcaagcaccaggacttttaaacaacacaataagtagaataataaagtaacacaaaaccccaaaatatgtcaacttcagatatcatgatgaagacaagtatttagcaaaatttataatgaacagaaggaaaaatcaccaggaaggctctgaaagtgcaggatataatatctgtttcaatttggtttcttttataaatttagtttagttttaatcaggatgtgcccttctaactttttacttagcagtactggacatcaaattttttcacttagtcatagtccactggatggatcataaagactaattgaaagggactgctaatcacccagatatcccaaccttggagctgaatgcaatcactggataatgttttatacttgctctttttgaggagtctgagcatctttgaaagtgaatatatgctatgaagggtgtatagcaatgttggatattcaaagaggaggactgtagtaagcactgcaattatacagtcaatatcctttcttctactctctgatggcacagtagcctggtgatttggaaagcattgttattactctcagttctagatatgcgctcggtttttgtgcaagccaagtgggatactgctatgtactttgcttcagggaggtgttcaggccaggcatatgatctaagagtttccaagcagagagaaactcagaccttttgtttcctatttgggtaaagatatattctttacatttagctgtaaacaagggaaaagagtttccaagatctgctgagggaagccggtctgtatgagttcgaaaagttatggagggtaggcttagattaacagagaagcaaagacttctccttaaatccataataaaactctgtattaaacccttgagcaaaccttgaactctttacttagccaacaaattctctttgtatcttgagtacatttgaaaccaagcatcctaaataatacaggatataatagactttaatgttcttcatcaacttaataaatccttaaataatcaacaatcattctaatatgtacttatatcatcttcagtgccgaatgttctgatttcaaattcaatgttcaattgctcagttcaccaaatctagttaattgctgttagtcaaaaagcattctcattaatgacactgatgctattatcaataaaatggagtcattttgaattggtttgcttattcatcaaatggaatttttagaaaggatgtattatcttactacaactaggatgccaaatgggaatttaatgcaccattttttcacaggcttgctataaatcagaatctttaaaacatttctctccaattctctctcttccactcctgaaagagatggtaatatcatctgaatctctttcaaggaaaaaagattaatgaagtcatctgttgatagatttcacagcaattattcttcctcattaccagttcccaaacttcacctttcattttataaagtaacctttattttaaacctgcctgtattttaccttcttattttctggttgcctgatttataatttgtcattatattgcttatatattcatccacttttagtaaatcatgaagtgtgtgcataagtgtgtttatgaaaacccaacctttcctctaatgatagcttcataaagctctatgttgtgtcattttagcatacaggttaatagaatcaattctggaatgagattgtgtgtgtgttcaaatcctggcacagctgcttttcatgtgcataactgtgcacagatttcttaaccagcttatcaattttctcaagtgtaaaatggatatattaacagaatcttctcaatagggttgttataaacattgaattaatgtatgaaaagtgtttacagcaatgtttgttatataatgattgtccaatatcagttagtaatttttgtgacattattcatcatcacagacattatctaagagtaactggttcattatctaagatcaacactcaggaaggagcttaggctaataaaatgattcagagcccagaaattggaaaacttgggttgagtgacatacctatcagtttctaaccatactactttggtcaactcattcaagatatataaggttgtttttagttgacagagttaaaaatttcatcttttatctcacaagtaagctcactggggcataaataatacaaagcacgtaaaagggatatgaacattttataaggtgtgaagaatccctcttatacataagagcataacacattcttcagttgaagcaatagagccctttcactacctgttctgggaatggctcaacttatgtagcacttgctcttgtctttccacgaacacaaagtttgcagctgaaacatgaaacctctttcctgcttcccaatctaccagattttcaacatggataatataacataaaggacttatctgtctgtaccatagaaataagtagtattttgcctggctttccaagtcctcagagtctcaccataccctatttttctcagaatttcattgccattttggggcaatgaattcttttgagaatatgattgaaattctggatcctttacactatgtgtacacaaaaatgtttggagattgtgttagcgggattgtggacgctattatgcacatttaacaaactcttagggttttataaactgtgatgattgttataccattttatttatctgcaccggcttatcattacaagctcagttaacattctccatccttcagtaattagtaatgttagcccgtgtctttaaaaaacaaaacaaacacatatgtattgaggtatgatgtcctctgattatatatcttaatgtagtattttattttatagtgtactatttaccagttctgccagtgttaatcattgtccgtaattagaatattatttcctatcttcagttttctctattaaattgtgatttttgaagaccatgtcactattttcctgattttcatttattgaaattgaaaaatatatgtaagagtttttcatttattgacatttaaaaatatatgtaaaagagttttacatttttaaattacatgttttatttatttttgcatgttttaaaatatgtaatttcactgacaaatgaaaattcagagaaatgaaactcctataaaattaattgaaaagagtctagtgtaaaatattctgaatataacctttgttctaagtacatatatagatgtataaccacacaaataatttattttttcaaaaccagtcacaatgttgtcttagctacattttcagttatttaatgtattgtaaaaatatgccatgcaattaaactcttttatatcttaactttgtagtggcttcatggtattatatcatttggagatataatttatttaaagaaactaacagtatattcacatgtgcatatttccactgaacacacattaatttcattaacaaaaagaaatacaagaccaaagaagttgacctctaaactatcttcctatacttctaatgtgaacactattcaatcatctcataatttaaattaaaatgaaataaactacataggcactggaattttgtttctttctacctcttaaaatttggaatgctcccttaaaattaatagattccaataacttacaagaaaatacccacctttacacaaagttactataaaaatccttcatgtgtgattaaaaaataatatttacatgtttactttgtgatcagatttatacttagcagctcaatttttagaataatgatatgaggaaataactattatgaagccattttatcaaaaaaagagcaaaatatcaggatctcaaagagctattagcactccagtgctcattatagcacgattaaaaatagtcacgatgtgggaacaacgtaaatgcccgatagctgaatggataaagaagatgtggtaaatacatacaatggaattttattcagtctttaaaaagaaggaaaacttgcaatatgtgacaagttggatgaaccttgaaggtatattgtaaatgaaaaaagctagacacagaaatacaaatacttcatgattctactcacaccaggtatctaaaattgccaaactcagagaatcagagattagagtggtggcttttagaggctgaaaggaggagaaaatggggaaatgctaattaatgggcataaaattttcatcatgcaagatgaataaattctaaagatctgctacacaacgttgtctctaataatactgtattgtacacttaaaatggttatttgataaatctgttgagtgtccttacagaagaaaagaacagttttaacaaatgttttatgtatcacaaagcagatgatgatgccctatggtgtttcttgctaacaattttcaacacattttttatgtaaggtgaaatgtcaactaaaatatccaaatagacaaaagtgagcacaatgtgcagtaatataccttaagtcacacatttagtaagtagcagaaccagaattacagataaaagtcagactgattagcaactgtgtttgcgtgtccgtgtgtgtgtgtgtgtgtgtgttgtgttgtgtatgtgtgtatgggtgggtgcctacatgcttagtatattttaatctcctaaaatcaaagggcaactgtccaggccaatatgagtacattctacgaaacaagaataaacactaacatgtgatcccttctctactcctccctcattctctcacagtcagagttatattatctttccctgccccatgaccaaaaaagaatctgtgcttttcacattctgtcctttgtgaagagaaaatttgactggtcaacataaacttacgcacgttgtcactcctgtgaataattctaataaataaatgactaggaactttgactccctccttacaactttggcaataaaacagatttttaaacatataatttgcataagttaatcatgtaaatataaaaatttaaacataaaacaaatgtactgaaagaaaaaacaactattatgaggtcatgtataacaataaaatcaccactgataaacctaacacactaaaaagtaagataagtctcaaagtcactggaaaaaaatatgtaatgaaaaatttaaagttataaatcttacaaaaatataggacagtgcctaattatctgagtgattaatattgctaggtatgctaggggagatcagccaatgcttagtccagtgttatagttgagccttttgtatttctacagttatatgttttgcttcatgatatggtataattggagttattccacaggggaagttaatagaaggaaagaataaagatcagaacaaaagtaaataaaatagaaactagaaaaacaatagaaaatagtaacaacgaggttttggtttttttttttgtgaaaagatagactggcttgttcttgacatttactgattccacaatatgcaattcagatttagtaaagaacatttactgaatggaaattgtcacccaactctttctggttttttgtccttgttaagtgaatgaacaaaattggcgaaaaattttatgtccgaaagttcttaaagtctaggggaaacatttcttatgaactaaatgtaattcaaaaacatttaacagaaggaatcttaatgtcaggcagtgagaaaaaatagaaagtcaaagatctctaaagatgggggtgatgaaaaagaaaaggaactgccttttatgaaaatggaaatactattttgtttactggggggtagatttaggtaaataataaaatagaagttttaattggcaaagcgaaaaacacttaaaacatgctgaaaaagaccacgtcaatcaattttactcactttaaacatgtttttttcattcccttttcacagtatactgagactgaaactgacacaagaaacgttcactaaattgttgatgttcgtttcgctctaatatttgtacttttttttttttttttttttttttttttttgagacggagtcttactctgtcacccaggctggagtgcagtggcgcgatctcggctcactgcaacctccgcctctggggttcaagcgattctcctgcctcagcctctgagtagctgggaatacaggcatgtgccaccacacctggctgatttttgtatttttacttgagacggggcttcaccatgttggtcaggctggtctcgaactcctgaactcatgatccgcctgcttcggcctcccagagtgctgggattacaggcatgagccaccgtgcctggcctaaatttttgtactcttaaaaaactaagctatcatattgattatgaccatgacacatatgaccatgaaaatatttttctaatatttaacgtaacgtttagaaacatcactaagaacttcaaatacaatcaaaatactgactttgaatattgtttttttcaaaggcctgacgtttttgtccaacacaaataagactgtcttcacaactggtcctcaggcactgagtagagtaagtttctccaagccaaaggctgtctataaatcttaatctacttttgtacactactaaaatttcctctcatggaatggtgaaaaatctccaataattcttatgctttaatttattgagaaaaacaattatttcattcaaaattaggtattacatctcaaattatgaatgcccaatatttgttaaaagactcatatatttaatattacttcaaaaattagtgaaaactttatataagccaatattttcaaaatgtacttaaaaatagaaatttcattttgagcctcaacattgtttgctgtctctctccccccatcaactctccttccacccaccccaacctttctccccagcacacacacacagaaacacatacacacacacacacagtcaaagttgttttgaacagaaaaccctcaggctacgccccttatatttgagacgggagtgggggtaacagtccacagctgctcatctacttctggtaccttctctagccttatttatttcctagttacatattttacatcacttttcactgatttcttctccatacattttctacctttgaccagtaagtgatagttttcctctttatctaatctttttgctattaggcgataaagaatcttagagcagcaaagattccaaaatatctgtttcgtccatctcttaagcatagggttatttccatggctttagtaataccatttattgaaatcatgtcccacctaaagtattttcattcttttcttatctaagcctcgtaaaaagctctgttcaagatgaacttactctatggaaatcttcctgagtacgagtcgatggaccattgtaggatgcataaactgccgattcttggatcccattcatcacgctagtaataagccttatatatccatatttgtacgatctctccaatcactgaaattagtttggaaaaatcaaacatgtgtttgaaatacaaggtagcatatcccaccttgtattactcattcttttatacgtaactcttctattacgatgaggttgatgggattaataattcatagtaagagaaggaagatgacgtaaaactgtgctgcagcagggtttatattgcaggacctgcttcaaaaccctgaacaatatattagattcacgggcagctgctcccttaagtattgctgttcactcaactcttagaatatacaatacaatcgcaaactggggcatataaaagaaacgtgatgctttcattcatttgatcaatatgctttatgtacctagtatatattctagtccttttcctcttggagtttttactcattagggaaaaacgacctgcaaatatcgtaatgtcagtagtgataactacaatgaggaaaaaaattaaagctttgaaagaagacagaacaatggtagtggcatatcaaatagggtagtcagaaaagatctctttgcagtctaaggtaaaggaagtgcgccatatgaataactgggggaaaaacccttccaggaagagggagatacatgtgtaaagtcactgaactcaaagtatgcttggcgtatttgatgccaagctagtaggccagtgtatctggagctgagaaatggggttaagggtaggaaagaaggtaggatacctatagggaacaaatcacgatggtgttttggattttcttccgagtgtaaagtgaaattatttcaggatttagaactactctcaacatcttctctacttactcagtttgtaaattccttaagggcaataatatggccatatatgttccccatgcttggttcactgtctctcattccataatagttaccactattccacaagacccatcgattagaattatggatttaaggcttgcaaaggagaagaaagctcatcttagacagctatatggttccagtacatagtaagtgaacatattaataagccatgtgtcccgtgaccgactgccttttacaaccagtctcattaggtagtctatacttaaacactactctgacagagggctcactatcccccaaagccttttattgcattttgagacatttctattagcgagtattcaaatatcacatatttgaccccatgaattttagcaagttaacttagtttatgatttcaattttggaatttaattttttatgcttgaagagttcatatcaaaaaaaacaaattttgagagcatggccatgtttttatttcatagttcattttgtccttagatgtttctgacaacataaatttagcagtgtagcagttattaacaccattcatatttatttccagctttctacctttgagacatgtaatacgaatatatttcttagttctaagttgggtgagaccatgtaactagttgtgctcgtgagttgtgaactgaagcagatatgtcacttccagttcaagcaattaattgccagcacaagacctttcagaattttctttccctttgcggagtgactgggagtatcctagatagtagctgtttcatcaggctgggtttccaaatgaccacaatgaatagcgttcccttgctgattcacagtgcacattggaatgaaaaagttattataacatagtgaaatttaataaccagatctagaatgactggtttagatggcacttaataaacattaagtgactagtaacacattctaacagcagtctttaacctgcatattgtgatacattagtaaatctccaaaccacaattgggttatcatggtaaagagctttatggtagtttctaggacatactaattactcaataattttctattgaaagaaggagtggcgattcctcagggatctagaactagaaataccacttgacccagccatcacattactgggtatatacccaaaggattataaatcatgctgctataaagatacatgtacacgtatgcttattgtggcactactcacaatagcaaagacttggaatcaacccaaatgtccaacaatgatagactggattaagaaaatgtgccacatatacaccatggaatactatgcagccataaaaaaggatgagttcatgtcctttgtagggacatggatgaagctggaaaccatcattctcagcaaactatcgcaaggacaaaaaaccaaacaccgcatgttctcactcataggtgggaatcgaacaatgagaacacatggacacaggaaggggaacatcacacactgggtcccgtagtggggtggggggagggggaagggatagcattaggagatatacctaatgttaaatgatgagttaatgggtgcagcacaccaacatggcacatgtatacatatgtaactaacctgcacattgtgcacatgtaccctaaaagtataataaaaaaaaaaagaaagaaagaaggagtgaatgtaaccattcacctaacaagaagtttttgagacatattgcctcaatatttcaagggccactgagtaataatgacttatttgtttaaaaattaagacggtaaaaatagtaagttgttaaatttccaatgaaaaaaattgcaccatagaagcaaaagtgaaatgttatagcacatacaaaacacacacacacacacatacatacacacacacacacacacacacacacacacacacacagtgtgtatacataatggatttagagttctagttatgaggatgagactagggaaataggcacagagataaagtgctgttagagacaacccatatgtataacttcgaatagaacatactccctatgtaagtgtttagtattattggtagatatgtgtattgctgtatgtatatacccacacacacacatatatatgcacacgtaacacacagatatatactctatttgaaaactttgcttataatctaaccatgtatcagtgctatctttacagcatggtattaagtatataactatagcatgaattttaaagatttcatgatattgcattaaaaatatttaccctaagttttattaatcctatggtgatcactattcaagtgtttattaaactttccctctttgaaaacctgttttaactatgtcttacatcatttcatttaccagattattactcctaaatttaaattttgtgattaaaaaattatgcaccagaaggacagcatcaatttattctgtcataagccctcttacaacttttgatgtttcctgtttctttatgttctgcaaaattatcagtattatcactgtttcaatctgcctatctggtagttaaaaataatttgattgtttatattatatttttttattaagtagatggtatgtctttttacatacttaatgatatatgggctttttcgcttttgtcattttctggctcatgttctttatgaattttcctattggggcattctagttttacttattgatttatcagcattatttatatatgagggctatcaatccttcgtatgttataaatgttactaataattttcccaactttatatttgacttctaactttccttagagtctttcttaaaagcatcataaccaatacatgatgcaagaattgccatactaaattcctttattgactccataaataattaactataatcatgctctatgaagcaatagaaatgttaagatttttaagagcttataaaaactttatttcacatttattcctggcttctaggatcaagtggccaataagcaattattaaattaatggtaatactacagtgcttccggcatacttgttcctgaactatttgaggtaccaaatagttaaaatgactttaatcacctagctcacctgaaatttaaattataaagtagaagtagaagaatccacgggctaatcttatttctcattccattaatgatctaaatttcttcttgaaatgactttttcaggtattataaagtaaatttgaatgtttcagaaagaggactacatatcttaggaagcagataattgccactggatttagcaatctgacacacaatatagaaatttctaattaaagttctatttttataatgctaatctttcagccaaaaatttccttgggacatgttataatgaagataaaatgtactaagattttaaattgaccagagttcccagagacacctaataaacattttcataaatattcactataagtaagttttattgtgaagtaatcccattgttatacatacctctcatcattggcatcattacactttaaataagttacctaatagaagtaagtatttaaaatgctaagcttgaaaatctggatttgctacacataaaagaggaacatgactttatgtagctgaattggtatgcagatgatctagaaatgaggagtttcataacgataccatcaactcatcattaatccttccaaagatagtttatttccccaaagatttaattgatagcattctcataatttaaaaaatgactgtatttctattaaactttataatgaacaaaatatgtgaccgttaattatgtgttgattttaaagtcactctaattattactaaataaggtatctcttcaaaagaattaatatttttctttacattgacatgcttaagggggtaaactcttagtgaaaacaaaaaagtttgctagtagatttgagacccacatggatttaacacatgtatgacataataggaggctctgtgttaatctacaagtttggtaacaagtttatgttgattaaccaagcattattacattttttcactgatattatttgtagataaagaccacaatatgcaaggatatgtgctgccagaattctatagcagggattaaaattaggcatgggtatccactaattatacattttaaggaatatatctgtatggccgggcacaatggctcacatctgtaatcacagaactttggatggccaaggcggctggatcacctgaggtcaagagttcgagaccagcctggccaaaatggggaaacctcgtctctactgaaaaatacaaaaattagctgggtgtggtggcaggcacctgtaataccagctactcaggaggctgaggcaggagagttgcttgaacccaggaggcagaggttgcattgagccaagatcgtgccagtgcacttcagccggggcaacagagcaaaaactccatctcaaaaaaaaaaaaaaaaaaaaaaagaaaagaaaagaaaagaaagaaatgtatctaagttttcattttcaatcatggttgtcatgtatcttaattatgatgttacaacactttgaatatagtttcattaaaatataaggttaataatttaaagagaaaagattaaaaatattaaaatattttctgaaaacaaaatagattgtaataaaattaatgcaaaaaagaaaatcaaattacttaatgaatgtagaaactagagatcgccctacagaaaatgtgacagtgtgatgaattagcttaaaataattataatccttaagaagacatcatgtttaacaaaattcaggatatcaggatcctagaccaaatatttctgctctgtaatcttaggtacatgacttagcatatctcagcttgagtgtcttcacctgtaaaatgaaaggtgtagaggtttcagtgtctacttaatattcttggtattaaattacacatacaaattatttccaaatggatttgaaatttcatttgtgctagaaagcaattaagtggccatttcggctcctactctgtgacacttatgtgcaaggacattctcaaacttcttaatcaggagcctggatatttgaagatctgtacaagcttacctaaaacaagtacagtcatcagtaagtagagtgcactttattgaacacctgttaggcaccatgctagccacatttcccaactaacctggattcttcagaagaatcttgtaagttctgacagattgtatttttttaagatggatacaatatgtttcatcttacatgttattcttcggatgtaacactgatacttctccatcaagagttgggtttatgtttctgccccttgactaggatggacccctgactatggaagaagttatactatgtgacttccaagactaagtcacaaaaggcaatagagtttctgcttggtactctttgggtcacttactcttggaatccagccagcatttagtgagtgactgcagattaaataaggccacatatacatgttccagccaactgccctggctgaagttccagcagtagccaccaggcatgttagtgaagaagccttcaaaatgacttcagcttcatctactattttattacacctatatgagaagccctgaacccatctgagacccagaatcaaaagagataataagaaaaacgaatgttgtttttataagctcccaagttttgagttgatttgctatatggcaatagttactggtgaacaaggtaagcacacctgtattacacaggtgagctaagcattacacaggtatgccaagagataactgagtcacacaactaaggtcaatcagttgtaacacgaattcttacttccataaagacttgatttgtaaaagaaaaataataaaacataaaaataaaaaagtattaaaataaatgtttgaaaaagatattccttaagaggcccttcctaaagaaggcatactgcatctagcctacatgtggagatccaaacaaactattaatgattacaaataagccgccctgacctgcttaaacaccggaacacagattagctaaattccatccaataattcattcaaattctaggaaccgacaaatcccataaaatgtaataaacatgacttaaatgagagcattcaaatatccttggttcgcaaaaattgactctatttttgtaacatccacagcaatacctctggacctatctctggtatcaagagacaaaaaagtcattttctagaatggttggtaaaattatatatcatctcttccagaaactccaaatatctttaccaaatgtaaaaatggactttcattctacattttttgacttatatttttaagattacattatcatttataaatataatgcaaaatggaagagtgttgatccacgttgttgtaaatatttctttacccttaactacttattgaatgcctgttgtgtaagaaggtgaatggagtctttcccctctaacactctatgtgatagtggaggcttttctcacatacactatgcattaattattttagccaccccatggaaagttgaaagtatctttattttagagatgagaaaactgagtaatagagagaaaatagcatatgcaggtcccacagactagattcctattatactcctgttttcatcttaatatcttagctatggaatattccttaatgttcttcgaaaagtttaacaccattaaaattcttatttacatcaaaataaacatgaatagaataattcagaggacaaaacaggaaatgtatttgggacatggatgacagaaaatttcctattcttatttagaattatcacttatatgtcaagaagaaaaataacattcccacactattcaaagctttttttaagcatcaatttcctaacctattttgataggtaactccatttgtggagttacatctttgtaagatttttttgaagatcagaaataataaatgtaaattacatgctaggcatttaacatatttcctaaatgcagacacacctagtggaataaatgatgtattttggttatactatccttataaaattttcatacttaatgagggctttaccttaaataactttttgtttttaagttacttacactaaatcatttttttaaaaacctctaggtttttggactataacacaataacgctcctttaatcttcataaagagaccactatgaacaattttacaccaagaaactgtaatctaaaaacatggttaaattcctagaaacataaaacctaccaaatctgaactgtgtaaaaatggaaaagtctgaatagatcaatacaagtaagggattgagtaagtaatttttaaactctcaacaaagaaaagcaaaagacgaggtgacttcataagtgatttctatcaaacattttttaaagaaaattaatgccaatgcttcacgaactctttgaaaaaactgaagtggagggagcacttccaaattcactttataaggtcagcattaccaaagccagaaaaagacatcccaagaaaactgcaactcaatatccttgacagatatagaggcaaaattctcaacaaaattctggcaaattttaacaacacattaaaaggatcatataccatgaccaagtgagatttatccttgggatacaaggatggttcaacatgaaaatcaattagtatgatacaccacgttaacagaataaataagaagtcacatgttcatttcattagatgctgaaaacttgtttggcaaaattcaacacaatttcactatttaaaaaaaaccattaaactctcaacaaactaggaatagaaggaaattgcttcaatgtaaaagccatatataaaaagatcgcaggtcatatcacaacaactgcgaactgaaaggattttctatgaaatcaggaacaggaggaacaaggtaagtatgcccattcttgccacttctaccgatggcaatactggaagtccttgctagaataattaggcaaaaaaaaaaaagtaaaggtatataaatcagaaatgaagaatgttattcctatttgcagatgacataatcttatgaatagaaaaccctagaatccattaaaaacactagaaccaatttaaaaatcagtaaagttgtaggatacaaaatcatcatacaaaaattagttgagtttctaggagacaaattccattcacaagagcaccaaaaagaaaacagtaataaactaaagaggtcaaagagtatgtactgaaaactataaaacattgatgaaagaaattaaagatgacaaaatcaaatggaaagacatcctacattcatggatcgaaggacttaaaattgtcattacattcaaagaaatctacagaactaatataatctttatcaaaattccaatggcatttttcacagaaacagagaaaaactctgaaattcatatggaaccacaaagaatcccaaatggctaaatcaaccttgagaaagaagtacaaaattggaggtatcacacttcctgatttcaaaatatattactaaactacagtaattaaaaataaattgtattgtcatgaagacagacatatagaccaatagaacagaatagagcccagatataaatctacacatatagggttaactgatgttccacgatagagccaagcatacacaaggaggaaaggataatctcttcaacaaatggtgttggaaaaactggatatccacgtgcaaaataatgaaattggtgcttatcttatgccatatgcaaatatcaactccaaacggataaaatatgtaaatgtaaaacctcaatccataaaactcctagaagaaaacattggaaaaatcttgtgacattcatcctcgcaattatttccaaaagcacaagcaataaaagcaaaaaaaatagaattaagactacataaaactaaaaatcttctgtttagaaaagggaacaaatcaacactgtgaaaaggcaatctatggaatgggaaaatacaaaccatatatatatattatgagaattatttctaactcagagctattaggagggttaaataaaatgaattatataaagaatacttcatggtatagctacattctaagttatcaaaaagacagcaaccaatatcatgattactattttaaatacatcagggcttaggtaagattttgtgatcagacctgaagaccttatattatattaacaactggttatcttctaaaatatataaagaattcctacaactcattggcaaaaaaaaaaaaactaaaaacgcaattaaaaatgggctaaaggcttgaacagacatttctccaaagacgacacccaaatggtcaacaggtgtatgaaaatatgttcaacattatgaattatcagggaaatgtaaatgaaaagcagaatgagctatcacatttatacctgttggatgcctactattaaaaaatggattagtaaggatgtggaataattggaactattgtacaccgttggtgaagtaaaaaatggcatggctattatggaaaataatatagttgctcctcaaaaattaaaaacagaactcccacttgatctagcaatctcacttttggatatttatccaaaagaattgaaatcaggatcttgaagggatacctgcaatgccatgttcattgcaacaccattcacaagagccaagatgtggaaacatcctcagtgtccactgatggatgaggggataaagaaaatgtggtatatacatacaagagattactattaatattcaaaaagaaagagatcctgccacattaacaacatggatgaaccctaaggacattatgggaagtgaaataagacagtcacataaggacaaacactccatgattctacttataagaggtatgtaaaatactcaagctgatcaaatcagagagtgaaatagtagttgctagaggctgtggagaggaggaagtgggaagctgctaattaacgaaggttcagctatgaaagatgagaaaattctcaagatctgttgtacaacttgtacctatactgaacaatgctgtattttacacttaaaaatcagttaagagggtgaatcccatgttaagtgttcttacacacaataaagtaaatttcaaaagaagttaaacgataagagtgtaactgttgaaaataacatcatcacatatattcacttcaaggttccttccagttttaaaattctactcagaagtcttcagtgtaccaatttatagagttgagctaaaacctaacaattctgtttctgggtaatttgttcagtcacatcaggatgtataaaggcttcctcgaagcaaattagtgatacttttaatctaaggagtggtctccctggctggcttcccatcctctgtttgccaattactttctacaatatgtggacagtctgagggacaagttgtgccaggagggggcaaaggcagagatagagtgaaaaatctcctctgcctcatcccctcccaacacaggattgctggatgtaaaatcacccagaagtgctttttctgctttataaaaggcattactatgttctgctctgcatggttccaagattgttcctcagcaacctcagaacaaaaaaggatatccttttccttagaatcttttactcggtatattaacttgccgaactctatacaggttgtgagtttgtttataaatcagaatccaggctatctcttctcataaaagtgctaataaaaacataaaaattttctcagatcagaccacaaaatcttatctaacccctgatgtatctaaagtagtaatcatattggttgccgggttttgagaacttacaatgtgcttataccatgcaatgttctttataaaattaatctcatttaacactcctaataactatatgagttagaaacagtttcaataatacacatgaggaaactgaggcccagagttcaagaaattctctgaaggtcacatagcaagtaagtaataatgaaggctcttaaaagtagatgtaggggggcagaagagtataggtaagagtgatgtcatatgagaaagactcaatttgcccttgttagctttgaagttgaaagggggcaatgagccagtgaatgtggtcagcctctagaagctagaaaaggcatggaaatggattctcctctacagcctccaaaaggaaggcagccctgctgatatgttaatgttagctgaatgagacctgttttaaacatctgaactaaagaactgtaaaataatgaatatgtgttgattaggggcactaggtttgtagttgttgcatcaaaaatcgaactaatacatatagacacatgattagttatcaggatgggttaatttaaaagaagtatgtttttgtccctgtggccatcaactattcagggtagtgttttgagaccgagtcttgccctgtcacccaggctggagtgcagtggccgatctcagctcactgcaacctccacctcctggcttcaagcaatcctcatgcctcagcttcccaagtagctgggattacaggtgtgtgccaccacactcgcttaatttttgtgttttcagtagaaacagcattttgccatgttggccaggctggtctcaaactcctagcctcaagtgatctccccgcgtcatcctccaaaagaggcgggattacaggcatgagccactacacccagctcgcggtgtagtttgtttttttaagtgttacaatgagggtagccttcacttttactgtcgtttgaacctactctaatcagcaacacctccaaatacacacacatgcacacaccactgaaattgttcttattaaaggggatataaactagagagagcatgtaactttatcggtcaaaatgggaaagttttaagagtgaataggagtgttagtaattccactgtagtaactgctatatattaggatttcccagacatcgtaccctactgttttcctaaattcactgaataattttcaatcatcatgttatttgaactcatcagcaatatttaatgtagttaggtatcttcctttctctgaaaacactttcttctggattccagaatgccacatctatcttctcctttttctctcccctttctagccacctttttcagcccctttgctgatgcctcatcatatatacatctagagatctcatctgtctacacatttttccttggcaatcttatcctggccgatggatttaaataacatctatgtgttgacttctaaattattatcctcaactctgatcttagaaccccttctttacatgcattcatagcctcataggcacctcaagattaatatgtttaaaactgaaatcctaacgttcactcccaaacctgttccttctacagtctcacccatcttggtttgtggcaactctatttggccagttgcttaagtaagaaacctcacggtaatccttgatttctctaattatttcataagtcacatctactgcatcaggagggaaatgactttgatgaaatattggcctccaattctgctaccagatatgctatgctagaggatcatgaaacagaaaagctcacagataaaattaaaaggctcatatcataccatttattttttttatttatgtatttttgagacagagtttcactcttgttgcccatgctgtagtgcaatggcatgatttcaactcactgcaacctccacctcccgggttcaagtgattctcctgcctcagcctcccgagtagctgggattacaggtgtgcgccaccacacccagctaattttgtatttttagtagagatggggttttaccatgttggttcggttggtctcgaactctgacctcaggtgatccacccaccttggcctcccaaagtactgggagtacaggcatgagccaccacgcccggccttaccatttattaaatgagttaaaaacgtatggcatgagggaagacagcaggaggataataaaattagaatactttcagacacagattgttttgcatgtttatgtgtcacttgcttcaataacagtacctggcacataataggtgattcaaacacaagcgctaaataatcaaatgtatgaatactgctctatgtgtgcgtaacgcaatatataagaatcaccgtcgagaaagtgcagcgtcaccctactataatgagcatgggcatggagttgaataaatgcaaatttgaattcaggttctgccacttactaattaggcctagaaatacaaattaagttggccaatttaaaacagagacaaaagcactctgagctaagggaagcataaaagctaatatggaaaattttggggcacctgtgtgggagaacgagtgatgtaatttggttgaaggaacatgaaatacgtgtgtaatgagcataaaaatataaaatattaatatatcataaatcttttcgaggcagtttaggagagtagccttgttatatggacaaaattaagcgaaaaaaattgtattattagggctctgaataacattaaaaaatggacaagaaacttcataataaacttcacttggagacatactaggtttgagatattagtggatatcaaggtatagatacatacaaagagttgaaaattaattggaaatgtggctataactcaagtaagattggaagtggtgaagacagagatacaatgatcatttgcatacagattgaatacagattgaagccaggttattaaattattattaaattatgttgataaaagaacaagtacagagataagaatgccaagatatttcccatgagtttcataagctaaagaagttggaagaacagaaagagccaggtaatgaaagacacagaatagtcagagaggaagaacccgctgagtgtagaggctgagaaaaatgtttcatcagtggtagaaagttaggagagctgaataaaagccatttgtctctgtgattaagaatacttatttgttgaataaataaatgaagttaaagcagagtgatgtgtctggggagtgagggcatgcacgtgttttccataggggacagtcacccacatggctctctcctcttatagagaacgttatttttctctgtagaccagcaagtaaacactttaataaagctttctgatggaatcagatccagcctgtcttgagttcctttgaagtagagcaggtacagcctgtaggggcagtgaaagctcagtccttttgacacttttgaaataaatgttcttagtgtgaataattaaggcatacacttatcaaacctaactacatgtaacatcatcttctgatatgcttcctttagtgacagaatatatcattccccatcccccatctcttgtgatttgtgctgtgtcttttttaaatgataaacattacatttatttgaatggcttattttaaataaaacaagtaagtgaatttgttgaattatctgtgatttatgacatattatgtatttggtaatatttacacaaaggtagaatgagcagagcctagcaagatgtaagtccatttgtaattacttcattaaggagtcatacctgagcgatgccttaatgaaggtggtgatgaggtgaaaatgtgctaccagaataggcattggagaaaacctagaaaaggcagctcaataaagtgataatgagagggggaaaaaaacccctatatctttgcttggtgtatgctccttaatcttaggaggtggcacttattccttaagtcttggtgatttcaacggagggaatggtgataaattgagtctagagagtcgatggagagtcaagaggtccagaatgagagagagtgagaagagagctttgcaagtaaactagccaaggatggaggtcataactatttcaaagcttagaattttcagctaatgcatcgattaactgccaaataaattactaattaaatgcacaccactatcttaacaaaaaattgagtctccaaaaatgtacacattttttagccgataggatcaggtctatcatttttaaactcccattcatagtgtagttttgataaaaatcacatcctctagcacgtttcgaattggctccattgagcaaaataaatcatttttgttaaaaagtaattcttgcaaatctagcaatcctagcacatttcattcccacgctgtaacatttataaggctatttcttgtatattgggttccatacaatattgaaagggtggaaaactccactgagtcttcctcatatagaaagtactaaacattgccgagaatatgacctggtttcagtgtgactttttcttataaatactacagagcctgctatacacaagtttaaattagcaaaattaaaggagagcatatgaagaagcttgcagttatatttttcttacatagaatatatattttagaatgaatagataaaataattcacttagaatgtatgtatttcctttacgtagatccagaaaaatctccccaaatagtgtaattagcaattttcacagatgtacctacacttttcgaagttacatatataaaacttttcatgagcctcatgttttttataaccattagcagcctttgtcaaagagaaccttagaggttattacataatgaaagtagaaaccattacgggaattcatatttatgaagaatcaacgtatagtaaacctagagaagactcaataacaaagcagaatcacatgagggaatcaataaaacttggaaaaacaaaccagctcttcacgaggagataaaaggcactgaaaaattcaagcaagtaaaagcagtgttagattatcttggaagcagttctctggtttgtacaacagagagtaaatgttgacagacctgtgaaggaaatgggctccgtgtagggtcagaggtggtgacataagcagcctgtgtgtaggcatagctcttgaatcgaggcttaggggaagaagttctctcatatccctgtgctagactgaccgtgatctgcagagaagggtttgggggagtggatagagaggagggggaaaaaccataagtaacccgaaaggactactttccaacatggtagaaaacagaacattaaatggaaatggtgagattcaatgtttaatactaaacatatataaatgatattcgaaattggtatactcccagaatgaaggcacttaatatcatgttggagagtaaatgatctgggaagatatgagcatgctatttagccatgaggattccaaagtaacacaactccaacatttatatgggatggtactcttcaatccggcaaaaacaggcatccataagcaattttctctaaatccaaagtaaataaaaacagaattcatcaggtccataccctggaaaggactaaaaatttcataagctaatacagagctagctcagcaaagtgagagagtttggcctaagagctctccacacattcagcagaaatgttgctaaaggtttcttcactgttgtttgtgcctgagaaagcataggaaaacatccaaaccacccactgttgagagaaagaacaagccaatgtcatggaagaaccccactaaattctatacaattatgtaacgaagaatttcatcatgtttttctttattgtttatttgaaatagtttaaaacacttttctattttcaaaattgttatcctgaataatcaaaatctgactttgtacatcatattgtcataaagtattttttaatgattaaaaactgtatttgcctttaatctttctctagctctttgttctagttgatgaagattttagagtttaatatgtacgtaagtttgcctttcatttcattgtgtgttacacaatggaaatttaatatattatgttctatattcctatgatatggtacatatgaatagtatttttaaaatatgttttgaaatgaatattgtagtcaatgaagcaaaattgaaaaggtttagtctgtctctttttgtacatatacatacattaggctttgtatatatacacgtgtatatacatataagttatatatatatgtgcacgtaatacctaaaaatgcatataaaacagaaaacatcttgaatagtagctgtcctttacacactttacctgttgagaatagtgcatttgatgatgtaactgaaaatgttcttctttagtcactttaggtggccttggcaacatttccacttcctggatggcttcaatgctcacttgttgaggcaaaacttggaagagtgatgtgatgtacattaagatggacttcttatctggataggtggtatcaacatctgtaagcacattaacactacacatcaatttttggtttctatatttgagactctaaaaggataatgaacaaatcaaagttaaaggaagacgatagattaatgaacagtgaattgtccatgaatgtcctccagagactaattagaacatgagaatgaggcctaaaatgtctttccaatttggcagaccaatgagatgagcagtaaagttaatttattttccttgttcatataaaaacttcattccatattactttttcctaagtcaaattgccaaactagcccatctaacagagtagctttcattagataagaaacaaaaataaaagattacattttccctccaatggaaagttatattaacatgtcaattcaaatggtgcactggtaattaaacaaatacacaaaatggtttaccgctttggttctcagtaaagaaacctgataccttttaactgaatgttgctgatattaaagtatgcagagagctaaataagtctctgctgaaatgagtcatgtatccacaatataaattaaacagaaaaataccatataatgatttttactattccgtgtatgttaaaaatatttgtttacattgtggtgcatgggataaagtagaatatcactttccttctcagacattagagacaaatgtaaaagtcccgcacattaagttgatctgacttcatatcctttgccacatccagaaagtgaatgaaacgcagcatttaaagtcaataatactttgtaataacacatataaagtggcagctccttcaaaagattcatttgctacttggcattaaaatttacttactgcactcattccagtgaaccaagatgtaaagtaatcctttatgtgaagtatgtcattagtactagaaatgttaacacataagttctgactatgaaatgctagcatttcattgtcatcctttttcatcctttaaaaagaaggaaattttgtcattgagacagcatgtgtaaatctggaggatattaagtgaaataagccaggcacagaaagataagtaccacatgatctcactaacacatggaatctaaaaagttgaattcatagaagtagagagtagaatggtgtttaccaggggctgtggggcaggggttgggaagatgttggtcaaaggacacaaaatttcagttagataggaaaaataagttcaggagatctattgtacaacctagtttataacaatgtattgtattcctaaaaattgctgcgagagtagatattaagtatactcaccatgaaacatgctaagcatatgaagtaaaacatgtattaattagttcaatgtagccattccagaacgtatacatatttcaaaacatcgtgttgtacatgataaatgtatgcaattttagttttttaatcattaatgaatataaaaatcaaagataaaagataaacataaatcctggcaggaggtcaaggtaatgtggcaatgtattttccttgccatacaatttatcttagcttaactactattaagatatctgtattcagtatgtatattctgatcaggtgttctgattataagtgaaaaagccaagagtaaagtctcaagtccgttagcacaaaagcaggttgaacaagtgacttcatcaattcttttgcaagtatcagaaccatgattaatcagaacagctatttttaaagtatttttaaaaagagttacaagagacgaaaaaattaatgttccttggtctacttctatccgtagaacaatacagtgcttctcaattcttaatgtacatatgaatcacctggggatcttttaaaactacagaatctgattcaatagatcggggtagagcctggagctctgcatttgcaatagtctcccaagtgatgctgaaactgctagtctgctacattttgaataagggccaaaaacattacttataagcagactgttacatcatctcccgttttattgttttattcatttattcaaatgatattagacatttcaatgcacaaggctgaaaggtacaaagttatacaacacatatggctcaacttattacactttaattattaatcaacagatggtcaaagtaatttttgcaagtactttttaaagaagaactaaataatattttgtgcatgaacactgccttccttaataatcttacaaacttagctttggaattctgaagcctagaaatctccaattcatttgataattgtttttcaaaatatttgaccaattgtttcttatatagtagatactatacttcaccgtatcttgaaattctagaaaatgttcttccttctcactagtaactagtcagctgtacctgtgattagcataacttagagctctttcatttttagtatattaaataaaaccatgatgtgagaaaacaaaaagggttgagcctgtgcctattcactgctgtgttatacatagacacatgcatgtatgtttggtctcaaatatatgccattataaaaagtaaaaaatggtgaaaaattggccaagcattatttttattgccccccaaaaaatttcaaacattgtaataaatttcatttacataaaacatgtggactaaatgcagctgttcataaatatcagtcattacaataaatatgcacttatttaaccaaactattgccattttgccccaaactattactatcccacttctgagattatgtggaattcaaaactgccagtaggtagaaataagtaatttttgaagaaaggaatttaggtcttctaaaatattttgaatttcatcaacatacattttcaagaaatctattatattcaaagtattttaatggattatccaggaaatttgaaagatagaaaattcatgaattctgcttctaatttggaataagaaagtaaataatagaagtacaaagtaattgcattgctgaacagaatttaaaatgtgttcctctaattggcacaaccagttgtttaacatgttcagatttttaaaatcatataatattggaggataaggcaattctctttaaataggaaactgaattaattatgcataggatttcaatagctggaaatgagggaatggggaagagtattcggggcagtgggaatatgtagaataaacatgcagaggtagggacacattagcgatgtcttggcaacagtggctttgtgtgtcttagagagagtagagtagtgaaaactaagatgaaactggtagattgtacatagaaaactgagggatcatcaacagcaaactagaaaacctggccttcattcaatagactagagagtaaatacttttcaatgagagggtgacaccatcaaaattttattaaagtaaattctttaagtacagaatggattgctggaggaaaacttgagagaaataggaggctaggaccataatccagatataaagtgttcaagatctaaggtacaactgtgtacgggggaaatgaaaacaagtcaatgaatgacaaaaattctaagatggatcaaaaatgacttcattcaattttcaaatcatttactccacagtctttggaaatgcctatatacaaagttatgtgctacagccttaggatataaagattaataaactgacaataaaacaaaggaggaagaggacgaaagaggacactgattgttctgcagccatggtaacaagtagacaccaacaaaagtttcaatctaccctatttattcatttaacaattagttcctccatgattcttatcatgcttcccccagccaaccagcagcaaacactcccttctgaaactttgccagagtggattcacttcaatgaagataattctcaaactaattaacaatggtctcacctgagttaccacgcttctaaagctatcatcatcctattcccaatctgaaatgttcttagattgctggacttctgactccccccgcaaaacctaagaatacgctcctttcagagactgtggttgaccaggagcattccctcttatttaagatgttatgaagcccaaatccaatgtttagtaaaactgtaaagtttgttgaaccttaataccattactatgttgcatttttttgtcatttttgtcatatttttgctgtttctatcattaacacaaaaacaaacctagttgtaggagaccatttgtatactattaacaggaagccagaagaatttacttagaaggaaaaagcatttatcacttattccatatgtgctaagtgattgtcatgtgctatagaatatacttagactatgttagattatgagtatatagcagatgagccaccccataattataaacattactttttatgggaaatcaaaataaatgttatggacttcggggtaatcctcatttatgatgactgcactaaggccaattcctggcactctgtgatcacctaagtatttgttaagaaactcaatacagaggacagttaaagtcatagaaattgatgagaattatgtaagacagtgactaaaggcaatggtatgataatgagtactataaagtatttgaggagtatgaaaatgatgggatgtaatttatacttcttattacacgacattaagattttatgaaatgagagcagtggctgaatccccaaagtaagaacttaacaattacatgaacgtaattttacaccaagactctactacataaaatgctcacggacaccagattttaataattgcttatccaatctttgaagccgtctcagaatgaaaatagtgagaactcacaatactgctagagattttactttatgaacaataacaccgtttctgatgagtgtttcatatttgaggatactatggaacaaataaatcatttagcgaaatttgatcatttttcgaataaagaagttgaacctcatggcggtctgaaggcaaattcaaaggctagtcaaaatcagattagaaaccagtcattgcactacactgccatggtaccttaacctcattctctcagatactatctcagtgtatttgaagaccaagtatcgcacaaagtttgctttcaacatgccctcaccccaagaaagtcaatgtgagtaagtaagatgaaagcagtgccttcaacaaaactaatcttgggcagtcaacctcagggaagtccgattagccagtcgctgggtgtaaccttcaaacaccgctgggaaatctaaagaagaggctctactgtctaaatttcaggccaagtttctgccaagggacaggcaggaatggaaatacagaattataatgcatagcatgtgtaattgaaaacaagcaagatttcaaagatagcaggtataaatgtgcactcacaaagctttagttggtcagtcttttaagagttttattaaacaacaaaaactgtgagaggatgtcatttagaaaccatgatgagcatcaacctccccacagggtttgtattaggaaacaaaaataaataaattcactgagaagaaaaggaatagagaaactggaaagaaggcacttctggtcataaactagccatagccagaatgctcaaaatatgaaaacagaaaggcctatatgttggcacaaccaaaacctatggttgtaaacaataacctaattcattgatgtgatattctaaaaggacaaagtgctggaagtaaagtggattattttttgaggcttgcatacgaagagatttatgttataatatcatctgatatctaaatgctggagtttctaagttgtagaccatatcatggcaatggactaattcattaaagcatgatattgttatttttaatattttgtatttggcattcagcactgactgcattgtacatacatgtattctctacttacaagtcactatatacaatagatatacaacattttaattaaaatttgcacaactcctcccatgttaaattttttaacattctgcaagatatgttctgccttagctaaattaagtactccttaattaatccatttttagcacttcattcactgatacaagcagttgcttttaccatttagtaacaatgcttctcattaaaggacggtaaaatgtcataatggaaataatttgcgttgatgaagatgattgaatttcatcataaaattaataacgataaaaagtaatggcctatatttatccaggagaaacacaaaacaattttatcttttgcactttccattacgcttttcaacatgcttatggtgtaactagcagaaaactatcaccatcatcttgttacaagtagaaaacagtggctcaggctgggcgctttagctcatgcctgtaatcccagcacttcgggaggacgaggcaggtgcatcgcctgaggttaggaatttgacaccagcctggccaacacggtgaaaagccgtctcaactaaaaatataaaaatttctccacatcctctccggcacctgttgtttcctgactttttaatgatcgccattctaactggtgtgagatggtatctcattgtggttttgatttgcatttctctgatggccagtgatgatgagcattttttcatgtgttttttggctgaataaatgtctcagggatctagaactagaaataccatttgagccagccatcccattactgggtatatacccaaaggactataaatcatgctgctataaagacacatgcacacgtatgtttactgcagcactattcacaatagcaaagacttggaaccaacccaaatgtccaacaatgatagactggattaagaaaatgtggcatatatgcaccatggaatactatgcagtcataaaaaaggatgagttcatgtcctttgtagggacatggatgaagctggaaaccatcattctcagcaaactatcacaaggacaaaaaaccaaacactgcatgttctcactcagaggtgggaactgaaaaaagagaacacttggacacaggaaggggaacatcacacaccggggcctgttgtggggtggggggagtggggaggggggagggatagcattaggagatatacctaatgcgaaatgacgagttaatgggtgcagcacaccaacatggcacatgtatacatatgtaacaaacctgcacgttgtgcacatgtaccctaaaacttaaagtataataataaaaaaaaaatgtaaaaattagctgggcatggtgatacacgcctctaatcccaggtgatcccagctattcgggaggctgaggttagagaatcgcttgaaccagggaggaggaggttgcagcaagctgagatcgggccactgcactccaccctgggtgagagagtgagactccatctcaaaaaacaaacaaacaaaaaattaaaaaagaaaaaaacagtggctcaaaatgcataatgcttgcctagagcataacagggaaaaaaggaaaatcagatgcttttagaagactgatacactgaaaactatttgagcgttctgttaatcaataaatcctaaacctaccaatacaaatggaacttatcatgcagccaatccagtaaataatggtagctggaagtaatgatagtgattgtaaaaactatggctgggcatggtggctcatgcctgtaatccgagcactttgggaggctgaggtgggcggatcacctgaggtcaggagttcagagaccagcctggccaagatggtgaaaccccgtctctattaaaaatacaaaaatcagccgggtatggtggtgcatgcctgtaatcccacctactcgggaggctgaggcaggagaattgcttgaacccgggaggcagagatgacggtgagccgagatcacgccactgtactccagcctgggaaacagagcaagactccgtctcggagggggtaaaaaaaaatctatattgaaaatatgagacacagaaaaatatactccacaaacgtttattgagttactttgtgccaggctatattttagactttaataatacaatggtaaataaatgatcccagagatatgttctcatgaaagaatgactgtaatgggaaaggaagttacgaataaataatttcaaaattctcagtttaccacttgccactgtatccctgcttcattgaattgccttccataaaagccctcttcgctgggatagtttttggaaattaaatcagaatggaagctctgcagtgttaataccaaacatcctgagagtgcctcagagcaaatgcacagaagctggtggggaaaagtcagttaaatgaaaattcgcaaccaactgtgactttaggagttttaaataagacgtgtttcagttgaaaagtttttcaaaaatcaaatttctgccgtgtgccctaatcaacaggaaaagttctatctttaaattttcaatttccaaatgcaggaaattttcaaaattgtctcttccgtcacaattgtcctaagtttacatatgttaaatatattttatttgaaaaatacatccttgactatttaaatccttagaacaaatatttggtatgtaacttctaaacccaggagaacagacactaacttgacataacaaatggaagctactcagtcagcatgggagactacagatagaaaaacatctgtactttcttacaattctctcgacatgcctgttgtgggaagaactattagggtttacatttgagatgaaagtattttgactcagtgacatttaactctgcttaagtgattgtcacctgcggttttcgtgctttgcttttgacctaaccaaattgactttttctttcctctgctgctagaaaaagtatagtcagtttcagaagtaactccaccccttatcttcctcgctaacataaaatagtctatttgtgaaccttaattgtttacagtgttagaagttatacttgatacacagtgaggccagaataaagatgtttatttcatgtgacataaatttaattggttattattctttctggtatattttgggatttcaaaatatgcctgatggtataagggcagtcctggggcaaattactcaatgatgactagcttaacgcagatattgtacaaaatgatcaggtttttttttttttgaaaaaaatatggtaaaaatggacccactacatataaaagagcttagcctgttgaggcaaaaataccttgatcaaatcctgaccctatcactaataggtaagggactgtggtaaaattcactaatttccctgtcccagtttttatctataaaatgagtcatattagtatcttgcaaataattagggatgatgttaacagagaaaatgaatgcaaagtaaatgctcaatatatacgatctattatttttcctgatttccttccaattggcacataattgtaattcataggtttgcttgcattcatgccttcattaagtatttgtggaatgcctaccatgtgtcagacatgataccaattcaccaagcaattaatcacgttttataattagaatggctccatttcctaattcctaaggaagaaacgagtggaccattggacaaaccagatggcatacaacactgatgtgactctctcagcacaaaacatttatgtgggatggtgtcatggtggtatcatatgtcatacgcaacatcagaataaggggttcagtgttgagcaaaacaccatcacacacaaacttcaacaactgacaaaataactgatggcgaattaagttttcctgaactaatccaaagttttcagtagtactctaactgaaaactgaaaccagtggacgaacatcacgcatttgtgtattttctaagcactactggaggcatgctgatgaaacacacccaatcaagaagtagcaaactttaacccattttcaaattacaaagatacattttccttttgacagtacttatgaaatttcatttgagtttggagtttctggcttccaccattgtaattaggacctcccaactacaaatacaataatatccatggatgtcaagtaatttccaatgtgaaaaaaatgcaatttagaaatttacagaagtgaagataatcaaatgtgaagcattgatggagaaaggtacaagtgaaaaagagagtaagcatccaaaaccatgtaacacaaatatgatgatgataagggataactttataaaagagaatgtaataaatgatgttaagaatgcgtaaaacatagctgagattgattttcattaaaatgtatatactaaagtatattttttgaatagtgaatagaatttgatgtatgtgttaaaagacactgccttccatgcctgtaaagtacagcatgacccaatccttcacacttagctaaaagcactctaatgtcatccctctttctctttcacacattggtcttgttttgtttttgcatctcaaataccgaaggccattttacacctcttgatcttcatatttggtgctcttttacctaaaataatttctctttttgcatttttgattcattctcacccattaggtcttaactcatatggcacctcttcagagatgcatttcctatcccatttaaagaagcccaacccctttccctttattttacattgatttcctttacattgcttgtcacaaactgtcattattatgtttattttttatataagaatataaaaaccacaaaggcaggaacttcctttagattgttttaccaatgactgagaagtagtaggtactcagtatttgttaaatcagtaaatgaatggagagagaaccttttgggaataaaggttcattttcatggtctacaccccctgaatgtagagtaagacacatgttgaaaattgagcactgcttgaaggggcagaaagcacatagcaaggaacaggagcagcctgtatttttctccctacaaaattctgcaaaagagattcagtttggtatagaattagtttttatcaagtatcaattatatacaagaacttttattatgtttttttttcatttaaattcaccactctcttgtgagttaagaatacagcccaaggtcatacaaccaataagtgacagtctgattaaagtggaaaaaaaaaagtagagtccttggtttggctcccagttctttcattttgtgaccttggataaagttaagcataatgcacctcagcttcctattgtattgcaagaagtttttcttattgatcacatttccaaaaataagacttgatttgaagaacatctcatgctctagaaactgtatcagattatttttaagtgatagggaaagaagcattaatttccaaattagagagcattagcaggttaatcaagaagcctatgagtgatgatgacaaagttagtacattttaaattcagattgaaaatactcaagacacaggaaaactaatgttttattcattgttctaaactttggcatacacactacaaaatagcaccgtgctttacaaaaacgtattttcaaaaataatattgactgatatctacagaaaaaaaaatgtactcaagtgctctcagactgaggataggaaaagcagactccttagaactttggaagcatagcttccaaaaattttgtgctaagcgtctgcatacctgggggtttgaaagattcaagtgtgtgaattccttgtcatctcactaaaactatgagtcagcggtgggtaggattctaccaaataatgataattgtaaaaaatgctttttaagctcagatatatgagaaagggattcaataaagaaacaaaaacctaggatggtatacacacatttataaacaatatgatcactaatatataactataatatgcatgcaaacattacatatttggaaagcaactccctttgactagatattagcaacttcaaagactaaatagagaaaaggaaaggctttgcgtagaatcttactgctattttaattactgaatgttccttttgtccatttgcaattttaaaatttcttctttccttttctcagtggctggatgagggttaaaactgatatgctaaataccacataacccattttcttggtatagcttccagttcttcttgactctgaaatgtcggcctctctcaaatacctctccctcaggtagagctctactagcaggggcctgtctttcctgatgaccagaaacccaggggcttggtataactatctcaattactatatcctatggagcctgactccttatcatagctccagtccccatatgggctctgatcttggattgaccagatgggtcatttccactcttatctcaatgggaacgtgccccttgattaggaaagctttccctcagagaaaacacatcccattgacggttttggccccaagagttcaaccgttagttgtctttgatattttaatttcataagtctggatttaatctctcacttttaaacattttattacaaaagccatacatgcttattgtagtggaaaactaaaacagtacagacgcatttaaagttaatagtgaaagtaccccatatctctacagcaccacagtcccattagctagaagtaatacttgtcaccagatgctatgtcatccatacatccatgcatctatccattcagccattcttttagctatccatttatcatactcatctgcctgtctaatgagattaaacatatacactgtctatgcatgtactttcttaagatgtgctcaattagtaaagattcaaaatttagctttaccactcactggtattatgaatttggataagaaacttaatttcttcatttcttcataccctcattggtaaaatgaggcaaagacttttccaagaaggtaagtgcaagtaaggcatttagagcaatgcctggcataaagtatgttttcagcaaatttcaagtttaaaatgtatatacacatgtatatatacaatgtgaacttcaaaattaatttcagtaatgcatgtattcatttatccatttatttattctgtaactatttattggacacttgccataagtcgaggattatgctggacactgcagctgaaatagtgagcaaaaataaaaacaaacacaaacaaacctagaccctgattttatggtgcctatagtccaatggtagagatatatctgcctaacagtccatagcatgaaaaatactggagctactgtgtacaacgctgcaatgaacatccttacacatttgtcgtagatatgtatgagtattactatatatctaattcttaaatgtgaaacctcaggatcaaatatatgtaaaattacatattttgaaagataatactaaattgtctgattaaaatattacaagttgtgtttcctccaaaagaaacacagggcctatttacatgaaccctcataataagaagatatttgtactatgcatttatttattagttaagcttaattttattttgatgggctatttctaattttcccaagtgaatgtcctgaccataatatgtagccacttttaaaatattatactttgtatattcattgtaggagtgttatcatactgaggttattgattttttattactagtgtcattctgcagtccatcataggttttattactgtttaatggtctttcacaatggaaaatattttaattttgtgttggtaaatttgtcggtattttacagcctctaggttttatatcaccttaatattattgtaatattcttctacattgtaataaagtatttaaatgtttattcacattcaatcattatctgaaagttatcttagtatttgttgtgccttgggtttccacagttgaaggctttattagctaacctattctatctctagagacatgaaatgtcaccctaattgtgtactaaatttacctaaataaaagggaatgttgtcaaaatatctattccacaccattaaattatttctctatcatgtcatactatgttaagtatgttataaaatctactaaagcaaatcacctgtttgaaaataatttcttaactgtactcacgcatttacatttaaacaaattttagaattatctagaaaactgaatccctcttaccattcatgtgatttatgttcagtgtgctcaccctgaacataaacaccctttcttctctgcttattctctaagtggctgaccctttcacactgtatctcctgtgatcattagctggctagattccagttgcattaagctggtgggaagtaccagctggagattgaaagaagagggaaagagaaagctggggaaatttctctattatttccctgctccagagctgcataatgtagtatctgagttctaccaacaactacattccctccattggtgcagctttcactgaactccgttccccctttcctttcagctactatatagtaggaatagtagaaatagtaactacttcctactattgctcctctctagattatttcttgtcacctatttgttaatatatacttctgtaacttttaaaatacaattatcttcattttaccatctgagataaattctatttattgctagggttctgttatatcctctaaaataatacaaatatagatacacagagagtcgcatacatacatgtttgtgggcatgtgagtgtgtaattatacagatgctcctcgacttatgacagggttacattccaataaacccattgtccatagaaaatatagtgagtcaaaattgcatttaatacactgaacctgtcaaatattatagcttagcctagccttccttaaacatgcaagaacacttacattagcctatactttggcaaaaccatctaacacaaagcctgttctataaaaactaaagtactgaatatatcgtgtaatgcattgagcacagtagtgacagtgaaaaatggcatgattaaatgggtactcaaagtacggtttctactgaacgcacactgctttcacaccatcataaagttgaaaaatcattagtcaaaccatcttaagtcagggaccatctagatcttgattgaagtaacttcaggaactttagatttaaggggtacaagtgcaattttgttacatggatatgttgtgtagtgatcaagtctcggcttttagtgtacccatcacacaaatagtctacaatgtacctaataggtaatttttcatctctcacccccttcccactctcccatcttttggagtctccaatgttgagtattcaattctgtatgtccatgtgtacccattgattagttaccacttataggaaaatacagtatttgattttctgtttctgacttatttcacttaggatgatagcctccagtttcatccatgttgctgcaaaagacataattttattcctttgtggctcgttagtattccattatatatacacaccacattatctttatctactcatggacacaacttgattccacgattttgctattacgcatagtgctccagtgaacatgcgagtgtgactgaagttactttcaatgtacaaactaacttagggagaactagcattttcatcatatgtgacttcctttcctcatgtctttatttatgtacttatatacaactttaaacttcctataaaaaaaagcttatactttcttgtgcggtttacttctaagaaaactacatagattttggaacttctcttttttaaaaataattttattgtgtgttttaaggtatacacatgatgctataagatacacatgtaaatggttaccataatgaaaccataatgaaagaaattaacatatccatcatctcacataatcgttcccccaccctctgaccacgagaagctataatctactcatttagtaaaaattctgaatacaacacactattaactataatcctcatgttttatattagatctttcaacttgtttatcccacatatttgctactttatagactttgacctacatctccccatttcctccttccacccccaacctggtaaccactgttttattctctctatatagttatacacaatggaatattacttggcctttaaaaaggagatcttgggccaggcgtggtggctcatgcctgtaatcccagcactttgggaggccaaggcaggaggatcacaaggtcaagagattgagaccatcctggccaacatggtaaaagccaatcactactaaaaattcaaaaattagtttggcttggtggtgtgcgcctgtaatcccagctattcaggaggctgaggcaggagaatctcttaaagccaggaagtggaggttgcagtgagccgagattgtgccactgcacatcagcctggtgacagagattccatcaaaaaaaaaaaaaaaaaaaaaaaaaaggagatcttgaccaggtgtggtggcttatgcctataatcctagcacttagggacttagggaggccatggcaggcagatacgcagatcacctgaggtcaggagtttgagaccctggccaacatggtgaaaccccatctctactaaaaatgcaaaaattagctgggtgtggtggtgggcgcctgtaaatcccagctacttgggaggctgaggtaggataatcacttgaaccggggaggtggaggttgcagtgagccactgcactccagcttgagtggcagagtgagacttcatctcaaaacagaaacacaaaaaaaggagatcttcttatttgccacaggacagatggagccgaagaacattaggctaagtgaaataagcaagacacagaaagaaaaatattgcatgatctcacttgtttgtggaaactgaaaaacaaaaagtaactatgctgagtatcattttattaccactgtacatttcctaattttgagatcattttacataatgagaaaatcatattattttcaaataatttatcttgtgctttccaatatatatttcatgtaactttctctcgtcatataatattggctaggttctccagaaaaatactgaacagcgtcaatacagaggaggaatattcttgtcgtatttattgtttgagtcattctagcatattgatatgatttggatttgtttccttgcccaaatctcatgttgagttgtgttccccagtgttggaggaggggcctggtgggagatgataggatcatgagggtgaatttcccagttgctgttctcatgataatgagttctcatgagatctggttgtttaaaagtgtgtagtactgccccctgctttctcctccttctctggccatgtaaggtataagatgtgcctgcttccccttcgccttccacaagaaggtggaaatttcctgaggtatccccagccatacttcctgtacagcctgaagaactttgagttaagtaaacctcttatctttacaaattactcaatctcaggtagtttatagcaatgcgagaaaggactaatacagaaaattggtaccgagaggtagggcactgctacgaagatacatgagaacgtggaactaactttggaacagagtaagaagcacacgttggaacagtgtggagcgctcagaagacaggaagatgagggaaagtttgtaacttcctagagacttgaactgcttggaccaaaatgctgatattgatatggacaatgagatccaggctgaggtggtctcagatgaagatgaggaacttattgggaactgcaataaaggtcactctcgcaatgctttaacaaaaagagattggcagcattgtgcccctgctctaggtatgtgtggaacttttaacttgagactgatgatttagggtatatggtagaagaaatttctaaccagcaaaacatttaagatgtgacctggcttcttctaacagtatacggtcatatgtatgagcaaagagattatctgaaactggaacttatatttaaaagggaagcagagcataaaagtttagaaaatttgcagcctgaccatgtggtagaaaacaaaagcctattttctcggggtggtgggggaaattcaagctgtctgcggaaatttgcataagtaaaaaggaactgaatgttaataaccaagacaaaggggaaaatgcccaaaggcatttcagaaccctttgcagcagcccctcctatcacaggtctggaggtctaggaaggaaaaatgatttcggaggccaggcctagggcctcactgctctgcacaacctcaagacactgctccctatgtcccagacactccagctccagctgttactaaaaaggccccagatgtgtcttggggtgttgcttcagagggtgcaagccataagcattggtggcttccatgtggtgttaatcctgcaagtgtgcagagtgtgagagttgaggcttgagagcatccacctagatttcagagaatgtgtggaaacacctgcatgtccaggtagaagtctgctgcagcgggggagcctgcatagagaacctctactagggcagtgcagaagggtaatgtggggttagagctctcacacagagtccccactggggcactgcctacttgagctttgagaagagggccactgtcctccagagcctagaatggtctctccagtgacagtttgcaccatacacctggaaaagccccagtcactcaatgccagcccatgaaaacaactaagggtgctgtacaccctgctgagccacagggatggagatgcccaaggccttgggagcctgtcccttgcatcactgtggcttggatgagatgtggagtcaaaggaaattattttggagctttaagatttaatgactaccctgctgggttttggacttgcacagggcctgtaacccctttcttctgatcgatttaactcttttgagctaatgcctgtaccctcattgtatcttggaagtaactcattttgattttacaggatcataggttgaagggacttgccttagtctcagatgagactttggactgtggacttttgaactaatactggaatgagttaagactttggggaactgttgggaaagcatgattgtattttgaaatgtgagaacaatatgagatttgggaggggttggggcagaacgatatagtttggcactgtgtccctgcccaaatctcatgttgtattgtgatccccaatattgaatgaggcgcctggtgggaggtgactgaatcataggggcagatttccctcttactgttccaatgatagtgagttctcatgatatctggttgtgtgaaagcgtgtagcatctctgcctgctctctcttcctccttctctggccatgtaagccgtgcctacttccccttcaccttccacagtgatttcctgagacctccccagccatgcttcccatacagcctgtggaactgcaagtcaattaagcctcttttctttataaattacccagtcacaggtagttgtttatagcaatgtgagaacggactaatacacatatcaagataaggacatttattcccagattagtaagaacctttctcaggacttggtaatgtatttaagcaaatgtcattggatatattacttttgcttttactgataggactgactagttctggcttcctgactttaagaaaaggaagaacaaagattaaatattacctgttcactgttttgcattttattattaatataaatatgtcacataaaaacatcaattaaatgaaagccctgaatttcatcactttaaaagactttccttattgctctttaaaatatatggcaaatgtggatggaagtacacacttagcaaataattttgtcagctaaaactttttattccaatgttgactcaagtgtaaatagttaataaccttccatatttaaaatgctccattaggtaaataatctgtaattggtgcctctttatatcggggaagaggctatattcttggtagcaaaatagtctgattcaattacctacatatatagttactcaactagagaaggtaggcaaataggtgattcacaaacactaaacataactggacatagttggaaatactatgaatcacccatgcatcctctatcatgattatcatagcagtgttcctcaaagtatatctcaacttatcagccattgcatccacataatctgatgaattgaaaataataattaatataagatagactggttggaagcaaatagcttcaaatagaaagtattacaaaggttcagataatcttaatagagctaagcttctagaggtttacatgaaccaaataaaaatcagcactgagctttcatattccttttcaatttctcattatcaatttgtttctctgtgtgagtgtagggtgatgaagaatgaagtagatgaaattttcagtaaagtatacatatgttgccaagaaatcagaggcaaataattctataactttgggtcattgtactaaataaaagagaaaccttagtattgcaaagtttaaactgattatgttaatatgcatttgcctccaaatattatagtaaaataatggaataacaaaatttaattctggtggaaatattttggatattgtacagatgcacatgatgctttgagcatattaaatgtagacttacttttgtgttcttatttaagttattttcactgcttggaatgcctgatactttttttttcatttatttagctgaataaatgtacatttactgttatcagtcagtcaatatccaaatgcttggtgtgcagttatttcccagaatacctcaagagcttggtacacaatgcccttttccaacctctgaacgtttatcaccagatagactctatcatataatacgttgttatcccagcttgcatgtgcacacgtgcacacacatactatatgacctgacccattagaattcattcattcatatatatatatatatatacacacacacacgttttaatattaaagtaaattaaatatattaagtaaataaaatacacaagatacttacaagtaaagcaaacaagacaacattactagcatttctttgactgtttctatctgacagagccactcaacactcgtaacacctattatacgagtcaaatcataccttacaaaagagtttttgtctaccacaattctttattgttgttaccttttctaatttttttcagaatgggaggggaaacaatatgaactcctagaagacaatgcattttaacggtctaataccaagactggctcattttgcacccattaaatgcctgtgaaaaaattgaccaaaattggtcacagatggaacacatctcattgctcttcttagataatttctattacttacattttcttttacaatcgtttttttacttagctcacatccaaatgagcaaattacattcatttggaaatgttattcgattcacattgtttgcccccatggggatttttttaacgcctttttagaaactacttaaataggtcctaaatttattatcttggtccatgggtgttgaataagcaaactgagaaaatcattgttacaactgtcaattctacattaaaaatgatgttaaaatctggtcatacatctctggatctgacatattttagataaatattagaaagggttaagtagctgaggcgatagacattttaactagctagatcaaatctttctcataatgtatgcatagatcaaaacactacattttaccccattattatctgcttttatatttttttaaaaaagggttagctgtatatcgaaactctaaatttatttatcccacataactgcaagtttccatgtacacattgacttatttcctcaccctcactactcctggtaatcaccattctactgtctatgtattcaacttatacattttcttcagatttcagatgttagataacgtagcatatttttttctgtgtcttgcttatttcacttagtgtaatttccttcaggctcacctatgttgttacaaatggcactatcttttgtgaggctgaatatttgtgtgtgtgtgtgtgtgtgtcacaatttctttatctgtcagtggacactcaggttattttcatatcttggctattatgaatcataacgcaatgaacatgagagtaaggctatctccacaaggttctgatttcattttctgtgggtctatacccaggagtgggattgttgggtcatatggtagttctatttttaactttttgaggaaacactcccagacaattttccataatgtctgctctaatttacaccgacaccagcagtatgtcagggttccctttcctccttgcctttactggcacttgttatctcatcttttagataatactcatcctaacaggtatgaagtaataccttattatgattttgatttgcatttccctaatagtgatattgagcacgttttaatttccctgttggccgtttgcacatcttctttgaaaaaaaaaatgttcaagttctttcccaattttttaattgggttatttagtttgtcactatggaattgtgcaagttccttatatattttggatattaaacccttatcagatatatgttttgcaaatatctactcataatctgtaggctgtgtttttcttttgctttccagaagctttttagattaatgtagttccactagtttatttttgttttcttgcctgaaattttgatgtgatattcaaaaaatccttgcaaaggcgactgtcagagagctttttcctctctgttttcttctaggagtcttatgattttaggtcttatatttaagtctttagtccattttcacttaatttttgtgtacagtataagacaagggtacaatttacaacaccatttattgaagagactgtcctttccccacatatcttcttggtggtcctgtccaaaattagttgattatataggcttaggtttatttgtgagatctctattctgttccatcagtttatgtgtctgtttttatggcattacaatactctttttaatactgtagatttatgatataatttcaaatccaaagagcagtatttccaacttttttttcctcaagattgttctggctatttgggatttcatgtaagttttataatgctcttttatttctgtgaaaaaaaatgccatttagattttcacagggattacattaaatttgtacagtcaaccttctatttccacggatgcaactgtagaccagaaataatcaaaaatagaacaaaaaactcaatacaacaacaaaaaatattaatacaagtaaaaataatatatggtaacaactatttctatagcatttacattgtattaggtgtaataacaaataatcgatagatgttttaaagtatataggggggtgtgcataggtatatgcaaatactatgccattttgtataagggatttaagcatctttggattttggtatccactggcatcctggaacccatgtcccgtggataccaagggacagctatatatccatttgggtagtatggaaattttaacaatattacttcttccagtctacaaacatgggatattttcccatatatttaccttttaatttgttcctcaatgttttatagttttggttgtacgtatttttcactttcttctttaaattgggtcttaaatattttattctatgttatcataaatagaattttttaaaattttttggatatcttttgcataaaaatgcaactaattttatgttgattttgtattccactacttactgaactcatttattagttctaacatttttcttgtggagtccttaggggtttctacatatacgatcataccatttgcaaacagaaataatattacttcttcctttcagatgtgaaagccttttattaattttgtctcactgctcctgctagtatttttggtactatgacaaatggaagtggtaagagtgggcatccttgctttttagcaaatcttaaggggaaagctttcagtacaaccaccccacaaccaccgttgatcatattagctataggcttttcataaatagccttgatgttgaggaaatttccttccatacatattttgcgaagagttataataataaaaggatgtttagctttatcaaatgctttttctgcatgtattgagataatcatgtggtttttcatctttctgttaatgtagtatgtcgcattgattgatttgtgtatgttaaaccaaccttgtgtcctagggctaaacccacctggtcacggtttataatccaatgtgttatttgtcttgctaatactttattgaggactttcacatctatattcctcctagatattggcatatatatattttcttctcttgcggtgtctgtttgactttcgtatttagggtgatgctgaagtcataaatggctttggaggtatttcctcttctattatttagaagattttaagaacaaatggtataaattactctttaaatgtttggaagaaatgaggagaagtaggtcaaaggacacaaacttgaagttatattggataaataaatctcgataactgcttagtatgatgactacagttaatggcattgtattgtacactgaacattagctaagaaaagagactttaggtattcttaccataccaaaacagttattatggaagataatggataggataatttggttgaattcagtaatcatttcattatgtctatgtatatcgtaacatcttgtaccccttaaatcaggggtatgtaatcttttggcttccttaggctccatttgaagaataattatcttaggccacacctaaaatacactaacactaacaatagctaatcaactaaaaaaaaaaacctgcaaaaaaatctcataatgttttaagaaagtgggtgaattacagttaggctgcattcaaagctgtcctgggccacatgtagcccatgggctgtgagttggacaaggttgccttaagtacatccagtaaaagaataaaaactaaaactaaaataattagcacatattgttgtatttcaaatgatgacaattagattcgacagttgacaagtcaaatataatacatttaaatggtgcaattctacttcttgaggaaatcctttcaaaaaattggtccaactggaatgtataaatatacaattaagaattgtgcatttaaaatcaaaagtaataataaactctaaattaaatcagacttttttgctgaaactaaacgaggtgaataaaataggtgaagtgaacctaatttataaggctgttatggctcaaattcttcaaataaatttctgttcagttcttatcattttcataaagttgatttatgaggaactatgcaaatctagagtagtctactaaagtctgctttttatatgcttatttcacacaaaatggttattgaccatatgtattttgtctaggcccttaccaagaggagctgttaacataattgatttacaattcagttaggaagaaaacatgttaaagctaattttactctgaaacaataaatcaacccaatgtgaagtatatcacagcccataaaatgaacagtgatccaattgtacagttgaaccatgtagctcacatatcccatggcacttaaaatcttcatccagtcattaaataagtctcaagatccaaaagatttacataagcacaactgaataactttattagctcttctcttctgggtttataatgatgaactaaaaatactaacctgttataaattacatcagtaatctttcagctctttttctcatcatattataaatttacaatgttactgagattaaaaaatgtttatcatatgttaattatttgcatgatctttagcatttttaaacaatggaaaaaagagagctaccaaaaccagagttgtgttcttggcatcagaaagctctagtaaacatcaaataaactttaacagcttagtgcgtaaataacacagcctcaagtacaacaccttagccacagatagtacttaataaatagtcattgtttggttgtatctgtgtaacacaacagaagaaagtatacaatcctaatccttgctttagaatctagacattgttttcttagccatttctgcaataacagttaaaataaacgtaccagcatttctggtaaagactctaatatataagggtgttccagaaatttcaatatactagatttgacagtatggcttgagagagggatcccactgctgagcattctctgcctctcatatcatggatcatagtcacttatgaaattttatctataatattgtagtccataggtatatatatgtatatgcatgcatgtgtttatatacatgctatgattctacaaaatacttgacatctttaatgaccgcctataaagatacacatgggctgaaaatggatgaaaaaagatattccatgccaatggaaaccaaaaaacagcaggagtggctgtacttttttcagacagaacagatttcaagacaaaaacaaagagtcaaaaaaggtcattatataatgagaaaggggtcaattcagcaaaaggatacaacaattgcaaatatttaggcacccaacactggagcacccagataaataaagcaaatattattagagctaaagagagagagagatctcaactcaaaggctgagtagggtactagggggtggaggtaagctggggttggttaatgggtacaaaaattccttagaaagaataaaacatagtatttgcgagcacagcaaggtgactatactcaataatttaactgtacattttataataactcagtatcattggattgtttataacacaaaggataaatgcttgagtggatggataccccattctccatgtgattattatttactgcatgcctttatcaaagtatctcatgtactgtctctctctttctatacatatatacacatacaaactatgtacccacaaaaatttaaaaaattcccctggaatatatgcaatttctaataggtatatctcttaatctaaataatgttttgaacattctcatatacttttatccaatatatatgttacaaatttattacagctgaagaatctacgcaatcttaactttctatggaggcaatgacactactataaactatttatgacactgcggggttagcaaatcaacccatgaacaaatgtcattttctcttttgatcatattattagttcgatagataaggtcatattcacaatgtagcttatcaatgtctcccataataaattcacagacaaaattttgaatctgtactaaaatatagtattttaaaaacacacatgtggcagcacaccctatccaaaaagtgatggcaaatggccttgtgtcagtttaaagttatatctacttgatggtcatgtgactctcatttggactgcttccaccaaatataccttgccaatgatcttggatcttaaggcataaaaatacagctattataataaaatattttactctcctggaaagggtagcttttactctttgtaataaaattcagctatggatgtcttagctataataatatcgaaaccagtaagataaaatttaacagatcacctttaagtctgaaattaatattggaaagagcagttataaggactgcatgggtttataaattatttgtgggaagttttttttattatttatgactgacatgataattatacatatttatggggtccaacacaatgtttctacacacagacattggatgtgctaattaccctgaattaattatcacatattcaaagaaattataaatatataagatgatggattcagatattatttgagaatcaaggcaattcaaattctaggcctaacgtttactagatgtaggagctatgactaccatgacgataaaggacaccaaaagtgagcccaataataaaggctgtgggtattcatcttggagatggtagattcataaagaccttttcaaatggttaaaggcagtcatggttcctctaggttgaagtaaaatcaatgtgtgaatgttacaaagatactgatgcttctttaatgtgacaaattttaggcatgatatcatctttaataattataatagactagcaaaaaaaagatctgcttcagaaacacttccaactggtacaaaaattcagttagtgaatgcatagatatctctaatctgcactagagaaggtaatctgcccagattggcttagattacacattgtgtcttatgttcgcacacattatctcatttgctcctcaaaaaatactaaagtaggtggaacaagaactatatagagatgaattcattgagacttgtataaaaatggtttcacgagaccattgagtttataacagagcagaactctaaattctgattaatgttcaagcaactgactagaccaccttctaaattcatttactagagtcctgcttacacctctataatcaccttaattaatttttctatatcaggcctctgcttgcattgatattattggtcccttcagtgaataataaaatacttgacgttcctatgctgaatttttagaaccaatatttccttaggaaaatatccggaaacatgactttcctaatttaggatacatgttactgcgtcataacaacaaatgtgttaaaagtatttgttgatgattttctcttaaatataaaggtttctatgatgtatatatacacacatatacatgtatatacatacacatacacacatatacatattagcctttaaaatatattccaattcacttttatttaccaaattagactgctgtaaaacatgattactagaaaatgtaccacacaaaactctgatcactctgatcatacttttgtttttaatttaactttttttgtaatttaatctccatagtttataaagggcattactgcttgtcaggaaaaaatgagcttgtatttctcagctgtgtgtaaattacatgcattttatattttttaggcaaggcctctatcaatcaatattttcagaaaatgacactcctcagttaggcagggattgttactgaagctgataaatgtttactcttcattggagactgacaaatagcatatgacatagactactcttatgctcttacactgcttgtactaaaacttgtctagaaatataaaattcaaaaatgtgattttcatgtaaaactgctttcaaatttcttgttaggaagcttgccagacactccagagtaacattttgtgaagcaagtcagtattacacgcataagtaaatgaagtagagatttaaacaaaaatacaacccaatgttgtaatacaggcaaaatataatatttttaaatgatcaccatgtgaggtctatattcaaatgtcttttcataaatggagtccaggcactctttgtagtttatcaagagcaggtttaacagcagtagtttccacaaagcaggctgaagtcatttaatccatggctgctttttatacgcagctgctttatttgagcttagagaggagtagaccacataaatgtcatgttaatattctaaagtgagttaaattgtgttagcaacaaagcttgtcttatcagacatttcaccttggcctatgagaaaatgtgatagttatggtattaattgatattaatcagtaaggcagatatctttgggaatataatgcatagaaaatagtattttcttcctcttcttcttcctgtatttttttgaatctcttggcttcagtgagaacttcctgttggatttattcttatctttccttaattgtttaattttcttctttccacagttcttaaactgaagaaggcctgacgttggccatagccacttaaacactgttagtctttccatcttgccatgccaaactgaaatacttttacctatccactcatttagtaaatatttactcagtgtctaccattttccaactaccacaaaaggtgctagggcgcaattatgaacaaagaagtcagcagatacttttttcacagagcttacagtacagcaaacgggcaacacgtgtaagcaagtaagttcaatacaggttgaacatccctaataggaaaatttgaaatctgaaatgctacaaaatctgtaattttttgagtaactacacgatcatttttaagggaaatccttattgaatcatttcggatttcagattttcagattatggatgctcaactcgtatgtataataaagatattccaaactgaaaatatccaaaatccaaaacacttctggtcccaagcattttggataagggatactcaacatatattttggggcaagttttattatagggaaagctaacattgcccaatatttagtcttgaggcacaaagtcaaccattaatgtagcacttcagctttggaaacatttcatgttaatgaatattttggctgatttttctatgtatgtatcttctgcctcttttcaaacactgattcatggtagcttggcaagctgaatgattctccaagaggagtattatatgcttcaatgtcttatcttaaccacccccccaatctatctttaacatttccacatttcatatatcatctcagcagatttctacccttgtaagtttttgttaaaaagaaatatgccaaatttaatagagtatcatagatgaagaagtgtatatttgtatacttatgtctcttaaggagctttttatactaagaaattcagaaaactacatgttctggttctttaataattaaatatgtgtgttattcttttgactttcctatcaaagtaaaaacgttgtctcagcagggcattcaacatatcttaaccattcaccatagtactgactatgtaataaacaattttctaaatgtactagcaaaactaaagcatatatagtagcacagcctctgctctatatgaccatggtccaggaggtatacttaagagttggttaaatatttatagctgagttagtcatgtttttggctttgggaaactgcagtgttcagatccccactgttaaaatgtaacgtgggccaggcacaatggttcacattcctaatctcagcattttcggaggctgaggcaggaggatcgcttgaggccaggagtttgagaccaaccggggcaatgaagcaagaccctgtctctacaaaataacaataaaaaattgtttaaatgtacctctgcattgtgttgtacacctgcaattctagttactcaggaggctgagctagaaggatcacttgactcaggagttggaggcctgtggtaagctacgactgtgctagtgcactccagcctgggcaaaagagtaatatcttgtctcttaaaataaataaaatgtaatggtgccataagtaaatgcatagatatgtgatccaatccatgagttttaaaatatgtcaggtaacaccaaagtaggacacaaaaacaatttgaatgtttatgaaaaagagtacttcaacaggaagtagacttagagagccataggacagaagagtgtcttcctaggcaataggaatgacgttgaatcacattttggaaatagtaagatgtttgccctaggaataagcttaaagtagtaagagataagactaaaagaaaggacaggactagaaagcctatgaaaaatattagtaactactgagtttggaatctttaatataggtagtgggagccactaaatattttgaataatgaagttacatgatgaaattagtattttattaagagtgtggaggctatgtattcaatagattcaaatatgaaagagatgggagatacagaaaattttcagccatgagcagaaaaagagtaggaatagagcctaccagtgggaaaattaaaacttgaaatattggatcagaaatctgatttgagaggaggagccaagatggccgaataggaacagctccggtctacagctcccagagtgagcgacgcagaagacgggtgatttctgcatttccatctgaggtaccaggttcatctcactagggagtgccagacagtgggcgcagctcagtgggtgcgtgcaccgtgcgcgacccgaagcagggtgaggcattgcctcactcgggaagtgcaaggggtcagggagttccctttcctagtcaaagaaaggggtgacggacagcacctggaaaatcgggtcacacccacccgaatactgcgtgtttccgacgggcttaaaaaacggcacaccaggagattatatcctgcatctggctcggagggtcctaccccaacggaatctcgctgattgctagcacagcagtctgagatcaaactgcaaggtggcagcaaggctgggggaggggcacccgccattgcctaggcttgattaggtaaacaaagcagctgggaagcttgaactgggtggagcccaccacaactcaaggaggcctgcctgcctctgtaggctccacctctgagggcagggcacagacaaacaaaaagacagcagtaacctctgcagatttaaatatccctgtctgacagctttgaagagagcagtggttctcccagtacgcagctggagatctgagaaggggcagactgcctcctcaagtgggtgcctgacccctgacccccgagcaccctaactgggaggcactccccaaaaggggcatactgacacctcacacggcagggtactccaacagacctgcagctgagggtcctgtctgttagaaggaaaactaacaaacagaaaggacatccacacaaaaaacccatctggacgtcaccatcatcaaagtccaaaagtagataaaaccacaaagatggggaagaaacagagcagaaaaactggaaactctaaaaagcagagcacctctcctcctccaaaggaacacagttcctcactagcaacggaacaaagctggagagaggatgactttgacgagctgagagaagaaggcttcagacgatcaaattactctgagctacgggaggacattcaaaccaaaggcaaagaagttgaaaactttgaaaaacatttagaagaatgtataagtagaataaccattacagagaagtgcttaaaggagctgatggagctgaaaaccaaggctagagaagtacgtgaagaatgcagaagcctcaggagccgatgcgatcaactggaagaaagggtatcagtgatggaagatgaaattaatgaaatgaaccgagaagggaagtttagaggaaaaagaataaaaagaaatgagcaaagcctccaagaaatatgggactatgtgaaaagaccaaatctacgtctgattggtgtacctgaaagtgatggggagaatggaaccaatttggaaaacactctgcaggatattatccaggagaacttccccaatctagcaaggcaggccaacattcagattcaggaaatacagagaatgccacaaagatactcctcgagaagagcaactccaagacacataattgtcagattcaccaaagttgaaatgaaggaaaaagtgttaagggcagccagagagaaaggtcgggttaccctcaaagggaagcccatcacactaacagcggatctctcggcagacaccctacaagccagaagagagtgggggccaatattcaacattcttaaagaaaagaattttcaacccagaatttcacatccaggcaaactaagcttcataagtaaaggagaaataaaatactctacagacaagcaaatgctgagagattttgtcaccaccaggcctgccctaaaagagctcctgaaggaagcgctaaacatggaaaggaacaaccggtaccagccgctgcaaaatcatgccaaaatgtaaagaccattgagactaggaagaaactgcatcaactaacgagcaaaatcaccagctaacatcataatgacaggatcaaattcacacataacaatattaaccttaaatgtaaatgggctaaatgctccaactaaaagacacagactggcaacttggataaagagtcaagacccatcagtgagctgtattcaggaaacccatctcatgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaaggaatcaattcaacaggaagagctaactatcctaaatatatatgcacccaacaaaggagcacccagattcataaagcaagtcctgagtgacctacaaagagacttagactcccacacattaataatgggagactttaacaccccactgtcaacattagacagatcaacgagacagaaagccaacaaggatacccaggaattgaactcagctctgcaccaagtggacctaatagacatctacagaactctccaccccaaatcaacagaatatacattcttttcagcaccacaccacacctattccacaactgaccacatacttggaagtaaagctctcctcagcaaatgtagaagaacagaaattataacaaactatctctcagaccacagtgcaatcaaactagaactcagaattaagaatctcactcaaaaccgctcaactacatggaaactgaacaacctcctcctgaatgactacggggtgcataatgaaatgaaggcagaaataaagatgttctttgaaaccaatgagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaagacaagaaataactaaaatcagagcagaactgaaggaaatagagacacaaaaaacccttcaaaaaattaatgaatccaggagctggttttttgaaaggatcaacaaaatagatagactgctagcaagactaataaagaaaaaaagagagaagaatcaaatagatgcaataaaaaatgataaaggggatatcaccactgatcccacagaaatacaaactaccatcagagaatactacaaacacctctacgcaaataaactagaaaatctagaagaaatggataaattcctgcacacatacactctcccaagactaaaccaggaagaagttgaatctctgaatagaccaataacaggatctgaaattgtggcaataatcaatagcttaccaaccaaaaagagtccaggaccagatggattcacagccgaattcgaccagaggtacaaggaggaactggtaccattccttctgaaactattccaatcaatagaaaaagagggaatcctccctaactcattttatgaggccagcatcatcctgatacgaaagcctggcagagacacaaccaaaaaagagaattttagaccaatatccttgatgaacactgatgcaaaaatcctcaataaaatactggcaaaacgaatccagcagcacatcaaaaagcttatccaccatgatcaagtgggcttcatccctgggatgcaaggctggttcaatatacacaaatcaataaatgtaatccagcatataaacagagccaaagacaaaaaccacatgattatctccatagatgcagaaaaggcctttgacaaaattcaacaacccttcatgctaaaaactctcagtaaattaggtattgacgggacatatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagagaaagtcaaattgaccctgtttgcagatgacatgattgtatatctagaaaaccccactgtctcagcctaaaatctccttaagctgatagggaacttcagcaaagtctcaggatacaaaatcaatgtacaaaaatcacaagcattcttatacaccaacaacagacaagcagagagccaaatcatgagtgaactcccattcacaattgcttcaaagagaataaaatacctaggaatccaacttacaagggatgtgaaggacctcttcgaggagaactacaaaccactgctcaatgaaataaaagaggatacaaacaaatggaagaacattccatgctcatgggtaggaagaatcaatatcgtgaaaatggccatactgcccaaggtaatttacagattcaatgtcatccccatcaagctaccaatgcctttcttcacagaattggaaaaaactactttaaagttgatatggaaccaaaaaagagcccgcatcaccaagtcactcctaagccaaaagaacaaagctggaggcatcacactacctgacttcaaactatactacaaggctgcagtaaccaaaacagcatggtactggtaccaaaacagagatatagatcaatggaacagaacagagccctcagaaataacgccgcatatctaccactatctgatctttgacaaacctgagaaaaacaagcaatggggaaaggattccctatttaataaatggtgctaggaaaactggctagccatatgtagaaagctgaaactggatcccttcctcacaccttatacaaaaatcaattcaacatggattaaaaacttaaacgttagacctaaaaccataaaaaccctggaagaaaacctaggcattaccattcaggacataggcatgggcaaggacttcatgtctaaaacaccaaaagcaatggcaacaaaagccagaactgacaaatgggatctcgttaaactaaagagcttctgcacaacaaaagaaactaccatcagagtgaacaggcaacctacaaaatgggagaaaatttttgcaacctactcatctgacaaagggctaatatccagaatctacaatgaactcaaacaaatttacaagaaaaaacaaacaaccccatcaaaaagtgggcgaaggacatgaacagacaattctcaaaagaagacatttatgcagccaaaagacacatgaaaaaatgctcatcatcactgggcatcagagaaatgcaaatcaaaaccacaatgagataccatctcacaccagttagaatggcgatcattaaaaagtcaggaaacaacaggtgctggagaggatgtggagaaataggaacactttttcactgttggtgggactgtaaactagttcaaccattgtggaagtcagtgtggccattcctcagggatctagaactagaaatcgcatttgacccagccatcccgttactgggtatatacccataggactataaatcatgctgctataaagacacatgcacacgtatgtttattgcggcattattcacgatagcaaagacttggaaccaacccaaatgtccaacaatgatagagtggattaagaaaatgtggcacatatacaccatggaatgctatgcggccataaaaaatgatgagttcatgtcctttgtagggacatggatgaaattggaaatcatcattctcagtaaactatcgcaagaacaaaaaaccaaacaccacatattctcactcataggtgggaattgaacaatgagaacacatggacacaggaaggggaacaccacactctggggactgtggtggggtggggggagggggtagggatagcactgggagatttatctaatgctagatgacgagttagtgggtgcagcgcaccagcatggcacatgtatacgtatgtaactaacctgcacaatgtgcacatgtaccctaaagcttaaagtataataataaaagaaaaaaaaacttaaaaatttcagcaaaccaaaatgtttgttaaaataaccattaaccacatatatatccaaatattcattatatataaaaaatttctttaaaatatcatgctcataaatagagtaagttttaattaacaggaaaattgtttcatatgttattatctttaccaaaaaataaaaatcaccaccaccaccaccaacagcaacaacaaaaggggggggacataaaatctatataattttttttttcttgaaaactcagcccaaatggccacctggtgcttcaagacgtgaagtgtgaatacatgtttcacttggaataaaataatatcttttcttatttacatccagatttcaaactccattttaccttgaacacaaagtaatgtgatttagtgtgaggaaagaaaggaaagctttttctatgaaaatgactattttatggtattttctaataattaggtcttataaaacttccccaatgtttttactacaatgctggtagaccacagccagtctgtcttgctccaggatttctgatgatcttattccattaaaaaaaaagactccacaagtcttgaaaactaaactatattagcatgtagttttgggttgatacaaacttctctcagctgcattcccattagataaaactgaatgatgcattggaaacttggaaattaaaaacatgtatctgtggcagaaagataatactgcacacaccatttttctttttgctgcttcactaaatcagttgatgctgaacacgcaataaggtgtataggccaggcccacagctccttttggtcaggtgcaattaggaactaatgttaactgtcttctaatgcgttacatcaatagtacatgaatgagtaataagctctaacttttgcaaaatatgtgaacaaattgatctactactcacaaactcattatccaacaaatttatttttgccctcacaaaaaataaacttataactgacaaaaaaataaaaaagaaatctgatttgatataacaggaattttaggaaaattaaagcattactaggagattcaaaaacggcttcatatagagttgataccatataaattgggtctatagaagcaaaagcctatagacatacaggaagctgtaattaaggtaatgagactagagctcaagtgaaatatgggcaaaactgatgaataaacctgattaagccaaaatcacagagggttaccagtgacttggttagaagtttgaacattttctaggcatccaataatgtggttgcgtaggcacaggaataaaactgagtttggttttggatgatggactttacctaaggtgggtcttgttgcttttaaaatcatcactcccttataaagaaaaaaaaatctatgcagacatcccaaaataacattaagacactgggcttcgacatcagtcctggattcattcaaatccaatctctacttcctattagttatctgtataatatgggtaaattcctttctctcctcaacagtttgcttctacattttaatgtacatgtgaagttcctagcccttaataaagcaattgtaaggcttaaataagaaactccaggtaaagtagctggcacataataagctcatattaaatattagctattttcacaaactgatcaggtttcttttcttggactgccggtgacacagcagaactagtaatgtagattttaaagttaattgaatggaggtaaaactaggagactgaaaacttcttctacatgttcacttgtcacccgtctgcagaacagaattggagaacatccataataacacaaggaaagagttagcagagcagataaggtatacgatatagatgatatggatatacttatagatggaatatcatactaggaagctgtcccaaattcatagaaatgaatctttcaaaaggagaggtgtgaaattcactctgaaattcaattagaatataattagtgactgttgagaatacagttttgatagaataaatgaggcagaagacagcttttaagggattaaggagaaaatggatattaagaaaatgtaacttcaggcatagagaataacttcaggatgttttgcaattataatggttataatggctcaaaacttgccaagtcctgcactaaatgtttcaaatcaactaattcatttaattcttgtaacagtcctatggtatgaatacaattctcactttcattttctagatgaggaaaaggctcagggatcttaagaaatttgcacaagtttacacagctaaaaagtggcaaggttagttttgacccaggcagtccagctccagaacctatgctgtcctccctactgttcacatggcttctgagacaagagtagtgatttaaatttagaacatgtggccaagtcttttaccctaatgtggcaaaatcaggaataaaaaattaagtgttttagtattcattttgggtaaatttctatgagtgcgcttgaaaacagttcatgaaactgagaaaaacacaagtgtaagattaccataatacaaagcatgtgatcactttggaaaggtgtatactactatggaaaaggtataggcaatacttctagttagaatgatttggaaaaggtttgtaggaaagatattttaattaaattccaccagaggaaaagaaataatacagcaattttgggaaattattaacagaccagtggttggagattgagataaatttggaaacttgagaagtatgtggttgaaatgtgaccatggacagtcgaaagtaccactgttgaagtgttttccattgtggaatcttaagagaagagcttttatactttagggcagcagttctcatagtgtggttctcagacatcagaatcaacagcaactgggaatttgtgagaagtgcaaccgctctggctgtactctagacctacaggatgagaaactcagggggtggatcccaacactccctgttttaacaaacctctaggttattctgatgcatgttcaagtttgagaacccttgttttaagggatgtggttgccattaagtctattcaccaaagttccattcttttattccaggctcctgatagtatcttttactctgcctacttgtactttgatatggccatgtgacttacttcatcaaattaaatgtgaacagaagtgatgtgcgccatttccaagcagaagctttacgggttatcgtgtgctttcacatgttctcttgcgttcttaaagtttatattgagatgacccttctctcagcccaggtccttcagctgagtacaatgagttgagacgcctaccaatctatagtgacatgaagtttggcgggaagaaaattctattcttttgagtcgctgagatatcagaattattcttatagatgcataatgtagtgtatcctgatttataggggccatggtacagagaagggatctatttcatggtaaagagaacatgtgtatcaacagatttatggtatctatggaagaggaaaacatgggaatcactattaaacctcagaaaaaaggatcatatattgtcacataaataagagaggagaaagaacagagagaaggagaagttaatgaccaccaacatattaacaatatttatctttcggtgtaagaattttacatgaatatttactatattattatttaagcattatataatcataaaatagaaatgaatattataaaagcataaagtttatgacacaaaattggcctcgaatctcatcttttggagggcataaactcatggaagactttcttaattagaccattttgtgagtgtatttactacctcttgatctgtatccatgtgtaggacactgttttaagtacttcccatgcgttatttctatgatctttctcatagacttgctgggtaaaatttgttatcccaaggttggcattgaattctcaagtgtttacataacatgccctagattatacagtaagtaaatatatactcatggattcaaatcaagttatttatgactctaaaacttaagttcttttcattatagcatgctgttgtatgaagatttatctgagtctgtacctacccagatataggaaggtgtgtgtgtacgtttgtttaaacaagttagtatatttggtaacctttagaaaataagtgactcttgtatgtgccgagaaggaggctggtgatttatgctcaatgtcatagtgtaatagaatctgtaataatcataataacgcaagaaaaatctgatgactggacatagctaatcacacggatattgccactaaatgtacttccattttacaataaagcgatgtgataaagaatcatgactctttgagagggcaacagcgctgacatttctaggtcaaaagttttcatgagattatggagtacctaaacatgtacaattagcctccagatgttcacacatctgcaatatattttttcaaacctttgtcactcactgtcagttaggattcgaaacatactaaagcttttctccccctttttaaacacaaaatcctaaaactttaggagccagacttggcacatatattgttgtcgttaaggtgatatccatgagtccataagacgatcaacaaccttatctgtctgctggattgtacaaacagaattaatagctgccttaagatagagtttggctgaacgagtagtacttctgggcatataaatggacttcagagaagtccatgaattttctggtatcatatgcaaattcttttgtgtttgtacaaatgtgcatgagagggtccaaagcttttgtcatatctctaattggtataataccaacacaatatttggttgcatagtcctgtgaatatactaaaaacattgagttgtatactttaaacagatgattgtatggcatataaattatatctcaataaagctgttccattttaaacatgactagcctagaaccttttaaataaacttgttaggcaaaagttgaagccgcttgatgtttatgttactattagattggtgcaacagtaattgcattttcttgccattgaaagtaatggcaaaaaccgtgattacttttgcaccaacttaatatatttttagaatgtgtgttccatgtcaaatggtccaactcttgactcaatcccaactaatgacctgttcagtgcccttgactatggtgccgtacacttggctatggtcatgccactatgatgacctggttacacagctaccacccattccctttggtaacagataacacaccattctgatattgtcactgcatcttctggcttgtatcactctacagtaatgacacaatccaactaatatgtcttttatttttaggaggaaagaatgatgtgtttattccgttctaaaataaagccaatgtttttattaaatattcttcgtgcccactgggatgtgaatgccaataggataaaatacatcagagaagcctaaggattccatgagaacaaggaatcagacaagtaatcatgtgccacagatagactcagctggtggaagtgaaaatattataggtcaagatgcctcataggtaagaggaaaaatgcgaggtagagaagaccgggagttaatagtgtaagtttaagctgctgggcaaggccgaagcatgaaatattcagaagggatacacagacacccaagctaaagctcatctggacaatcacaagggtttagaggagagtaaatgggacaaaagaatcaggaatgagacctaagcaatgagaaaatgggaagtaaattatgaagatacaaggcaacacagacattgggcagtaggtataaggaaaaaggctggggccaagaatcaaggctttggcctgcttcccatatgtgtgatatttgacaagtaagtaatcttttcgaaattttcatgttctcttctgtaaaattgttacatgaataatttatttaatcctcactgcaatcctacgatgtagatactattatgatccccattttacagatgaagaaacgaaggccaagagaggataagtaagttgccagagatcacactgctagtaaatggcaaaatggagattcaaaccccattaggctggtgctgatgataccctgtctcttcctctgagtccttcgcatttcagtggacattgttccaacttccacctgccagctcctgcatctctttgcctactggagtctgttcttccggagtgcatgcaatagatcaaaaatgctagggagtgaatgcacagcccctcccgggatctgccaacagatgaccagcaggagttggtgtataaataccttagcattctcatctcttcaaaggataagtctgaggtgtgtgttccacataattttcttcaagtccccagtcaaattgagcgccagttgtccaccacagtttaaactcttgaaatgtagtcttcattgactttccttccttctttgtctcactttatcattttcctactcatattccctagcatctcatcccaaataaactagaagggggaagtattctgaaaatcataaagacagggtaaatttaaactattattttattatcattattagtaacatcgatatctgagccaaaatcaaaaaagaaaggacccttatttgtactctttctggttaggattctaaccatgagtgttagaatgttgttggcactgaacccatagttacagtttccaataatttctgaatgccaagaaaagtgaccgtggaaggaaagcagagtttttaactctgtggaatgtgttcagtgggtgaggaatgggaggaagttctattttgctctcagtagaacattaaaaatggcttcctctgtaaagcattctgtggttcccccaagataagggcaggtctgtctgtcataaactgccatagcacccattacttatacaactaaataaaatagtattgagtgatgggtggttagtctctccaatgtagctctttttcaatgaaaatagacattgtgtttcttccagggcctcacacagttccctatatattttacataaaaaaatatatacctaaaatatttggtgcctaataaatatatagaaactatgctaggcacagggcagggtgtggtgatttagctagactatttaccctgtcctcataaacacacaaaatggatttaaggaacacatattcatctttaaaccctctctcaccagctagtaagcacactcagggcttttcagttaccctctacttacaagctatttctgaatcatttctgcaaccatcttctaggaaggataaccattcttacaattttttttttttttgccattcctccaaagttgctcttttgaatattatcaaaacttccaatttgccaaatctaataaactattttaacccacatcttacttaatgttttcagtggaatttagtacttaattattcctctcatgatcaaccctcccacctctctgccacaacctttttggtcttcctagcattgtgtgatcttggtgtcttcttctcataaggcatattctctcatggtttcaactgttaaatatgctaatgattaaaaactgtgcacctatctgctcaaacctcctttttaaggttcagattcatatacatggtggcctagtagacattttaccaaaagcacattaaattagacctaagaaaaatgaaatccatcttctttactccctccctccaaacctcgttatttaaactggacttctgttcacttgtgtaagacattatcatacagatcatcctagcatacttcacctccctatcctgtcatatctagtcattccttaagtcccatcaatgaatcttctccatcccaatcaatcctcttcatctgctttgtcaatactctaggttcaggatataaacacttttcatctggactattaccagtctccgaaaagatacaatttttctcaaatacgtatgattttagaagagattaccatcaggatcattggctcattatcttcagggcagtgatgcggggtgggagagttcttaaaggactgtattctacatgtgattatgagtcaaattttccagaccactgtagacacaatcttacacttcactgtttcacgcagctatgatacctacacaacaactgtaaggatgtgagtttgagatgtagattgttattgcagactaacaaccactccttgctaagtttgtttcaaaatggacttaagggggtgatctcagttgtttttggcaagaaaaaagtaattggcaagaaaaaagtaattggcaagaaagccagagaaagagaaagaggaaatgtttgttcagcccatgaatgagtaacattacaatgctttttataacttcaaacattcacccccatacaaatgctctataaaactattgtcatgatgatcaatcagcattttaagttgaaacatatatatccaagtttctgatcttgttctgtatcaacacagcactcacagaactcaggaaatccctatagcctccttagcttccatctttctcttgtcttttgaaataccttaaagcacaaaagcatattttcaggcaaaggtaaaaataattgtaggaatgatggtttcacagacagggtgtcttcagtgacagttaagttcctatggtgagacactgtaatgagttcaaagtgtttacagcttcaatactgcttgtcaaacactccttcaatgcaatgaattcttggctacaagccacaaatgtgctttgagaaataaaaagcgagtgaatatactggtgtttctattattggtccagctgagatagttgcttttttattcttaataaaagttttctcgaggtagtcataatttcaaaaccctgcttatagtaatgaatcatggttatttacaaagtaattcagtttcactatgatcacgatttgtataagtaatgtagtcatatagtcgaagacttttcagggatgttttctgtttaaactgataagctgcaaaattctgtattttccttaataaaaatgtttcaggaaaaagacagcgaacagctagatttgaagagtaaaaataaagaataaagccagtaggaaacacaaacttctagaacttttaaattgttaaacatctttgtggaagtaactaccattttcaccaaatctgcaaatcatattccaacaagttgtaaaaataagccataattcttagaattgaaagtctcttatcattctacaggtaataacatgacttggtcctgttctctgggtaatggagtaaaatgttactggcatattcccatgtttagacagatttgcaaatagccccagagaattccattcctaacctgggatatgttactcaaagacgttctatctggagtcaagctttcatacaagaatcatagacatacttcaagggatccatgaacactggaaagtatatggaaactatgttcacgttttttatttttcaagaaaatctacaccatccagcagaatctcacacagatccttaattttaaaatgagttaagaagcagtggtctagggcaggctatggttctcaaagtgtggatccagaccagcatcagcgtcacctgggacctttttagaaataccgaatttcaggactctcccagacttacttggttagtatctcagggagtgagacccagaaatctgtgttttctttttaatgtttaatcgacacataattatgcatatttaggaggtacagagtgatattttcctatatgaatataacatgtaataatcaaatcaggctaattatcatatccattacctcaaatatttgtcatttctttgtgttgggaagtttcaaaatcctctcttctagctatttaaacatgcacaataaattactgttaactgaagttaccttacagtgctttagaacactagtacatatccgtcctatttagcttatcattttgtatctgttaactagcttgtccctttcctccctctcctccctcttaccctccccggcttctgctaaccactattctactgcctgcttctatgaaatcaaactttttagctctaacatatgaaaacttgtgatatttatctcttcgtgcccgacttatttcacttaacagtatccaggctcatccatgttaccaccaattacaggatttcattctttttatggctgaataatattccattgtgtttatatgccatatttttaaattcatttatctgttaatggacacttaggttgattccgtatctcaacaatctgttttaacaaggcctccagaaaattctgatgtgcactcaagtttgagaacctctaatttgcgcaacaattttcaaatggattttttacaatgtctcctcaaattttgattcagttatgtttgggaaatatattttaaatcttcccaggcaattctgaggattaacctgtttgggacagctactccagggcaaagctactcaaactttagttggagaacgagtaccatcagcctcacctgggagacagttgtggctgcagaatcttgcccacatccttagacatactcaatcaagcgtgagagtgagacctagggatctgtgttttgctgggtttatttatttacttacttactgtatttgaaacaagatctcactctgttgtccaggctcgagtgcagtggcatgatcatgcactcactgtagcatcaaactcctgtgtttaagcaatcctgatcctcccgcctcagcgtcccgaatagttaggactacaggtttgcactaccacacctcgctaattttttttttaagtattttttgctgtgtttctcagtcttgtctggaactcctgggctgaagggatctgcctgccttggcctcccaaagtgctgggactacaggtgtgagccaacatgccggggaggaatccgttttaaccaccaccttccctgatgactctgatgcaggccacactttgagagcaaagcacagccacagaaaaaattagaaaagttgactattcatgtgacacaaaggcatatagctatgccttctatatgtaggctttgaataacttttaataatagtaaaaaagccaggatagcttttaataatggtagaagctactctttatttggtacttactatatgacaagcacaatggtaatacacgtatttcccttttatccttaaagaaaaagtgtaggccaggtgtggtggcttacacctgtaatcccagcactttgggaggctgaggcaggcagatcacctgaggacagaagtacgagaccagcctggccaacatggcaaaaccccgtttctactaaaaatacacgaattagccaggtgtggttgcggatgcctgtagtcccagctactcggggaggctgaggcaggagaattgcttgaacccgggaggcagcggtagcagtgagccaagatcatgccactgcactctccagactgggtgacagaacaagactccgtctcaaaaaaaaaaaaaagaaaagaaaagaaaagaaaaagaaaaaaggaaaactgcgagggtggggcatttaatcctgttatacagataagaaaactgaggagcaaaaagtttaattttcattaagtaccatagccagctggggtatgagtccagtttgaaagtttgtgattttaataattacatctacagaacttcagaaaatatattttgaaatgagtcttagggctaggtaaacccatgcattacatgtattattaaagggaaattaagaatgatatctcaaaccataaatgatggtattaggtaagtcagtaagtatatcaacatgcaaattaaaacagattatcaatacatagggattgactaagtataatatggcaaccaaattatcccagaattgccctctcaaagtaacaagagcttatacatgtgaacaaattttacacattctgtgatgtaaaaagactgtgtcatcagtcattgcagagaaccaggcagcaagtcacttccttacaattgttcacagctctctgattagctactttgcctgaagcataaaacataagcacattcttcctcacctctatgggtactaactggactgtttaatgtgatggagtaattaacagaaccttttctcccattggggacctacgtggcaagtgccccattaggtcctaggtacatacagaacccaaaaaatagaagccaatgtggggaggaaatggaactcattattttatatgctatggcacgatttcccccctaccaaatttactagactgattagtaaatgtaagccaaaatctaaggtgtgattgaatcactataatatccatcccttgagaactgtgactcagcagataggaaaagagaaaactaatgtccaacatcttgtcactgacacttgtgaaattatcatttgacaaaccatgaaataatttggcaggaatccaatacaacaaatgagtcatttcattaaatacaattctgtctccccagctaaatggtatgcaatgataagatcaccattttaatagttatctagaaatagatgcctaaaattctttcctttatgactttttaacagccaacctgagtacaataatgatattatccagaatttatatggtcaacattcaattgctcacaaggttattaaacagtttataaattatcctgttttcttcccctgctctctgctcctaagaattacatttcttattagaattttcctaaggaaatggaaagaatgaatggaaatgaagtggaaatgttcaatatttcaagttcttaacacgtttggacattatttgaggatcctggctaaagccaagatttgctgaaggcttttagggttcccagttgctataatctctttaagactctgataattgaggtagacaccaaggcagaactacgtaaaattatcatgtctgtaaacaacaaaaaaatgacacacaattaaaagccaaaaaactcattattgaatcaatagtgagaatttatgtggctaacaccacacatagcaaaaaagatttgatgttaggtattaggaattgcagctgttatatgaaccaatgaatcacaatttgttcatattaagacataggtagttatatacagttcactgatcttttttgaaatgtgattgtgagccatttccattggatgaaaaaacagacgccttgccttatttgtcacttttacccatgaaacctagtacatttctacatatatagaagacactcataagtgtttattgacttgtgatttacaacattaagaataaacagagatttttccctaacggaaaatcatgtatattgctacatttatgttaatcataaactctatgaaaactagcatagcattagagttagaaaactgaatcatgtctatcattttcaaactctatccatccttgagaaagctagtttcttcagattaaaatataaatacatttaaaaattctgacaaaagggagaaaaacttcccgtgtttcatatgaagttaggcgaaatttgatttacatttggaaagaagagaaatccacttattttagaagtaaatcaagaaatgtgcaaaatatctatcaggtatgaatttaaaatatgatattcattcaataatttataacagattgctataaatcagatacctgtattgtatttcttccctgtgtcaggttttggaaaccacagagaagtgcatatgacagtgacaggaagcagagccaaactcctaggcagataggggtgggtacccagtgaaaccccacttccaagctgaagacagttaaaggcctgaaagccaaactacaaatcaaatccttgcagtggattgagaacttgtcctcctatttggtgtgctttcctctgattgatctccacccttcacctattttacttatacctactgatatggtttggctgtgccctcacccaaatatcatcatgaattcccacatgttgtaggaaggacccagtgggaggtaactggatcatggggtcaggtatttcccgtgctgttctcatgatagtgaataagtttcacaaaatctgatggctttgtaagggggagtttccccacacaagctctctgtctgctgccatccatgtaagacgtgacttgctcttccttgccttccagcatgattgtgaagcttccctagctacgtggaactctaagtccattaaactctttttcctgtataaattatccattctctggcatgactttatcagcagtataaaaacaaattaatacagtgaattggtaccagtagagtggggtgctgctgaaaagacacgtgaaaatgtggaagcaactttggaactgggtaacaggcagaggttgcaacagtttgagagctcagaagacaggaaaatgtgggaaagtttgggacttcctagagacttgaatagctttgaccaagatgctgataatgatgtagagaatgaaatccaagctgagatggtctcagatagagatgagcaacttgttgggagcccgaacaaaagtgactcattatattttagcaaagagactgggagcattttgctcctgccctagagttatagggaactttgagcttgagaggggtgatttagcgttatctggtgggagaaacttctaagcagcaaagcattcgtgaggtgacttgggtcctgttaaggcattcagttttaaaagggaaacagagcataaaagtttggaaaaattacagcctgacaatgtgataaaaaagaaaatcacactttctgagaagaaattcacgcccactgcagaaatttgtataagtaacaaggaactgaatgttaatcaccaagacaatgagaaaaatgtctccagggcacgtcagagacctttgtggcagcccctcccatcacatgtctggagtttaggaggaaaaaatggttttgtgggctaggcccagggtccctctgtggtgtgcagcctagagacttggtgccctgtgtcccagccactccagctgtgactaaaaggggccgaggtacagcttgggctgttacttcagagggcggaagcccaagccttggcagcttccacgtcgtgttgagcccgcaggtgcacagaagtcaagaactgcggtttgggaacctctgcctagatttcagaggatgtatggaaaaacctggatgcccaggtagaagtttgctgtaggggcagggccctcatggagaacctctgctagggcagtgcaaaagaaaaatgtggggttagagccctcacacagagaccctactagagcactgtctattagagccatgaaaagagggccactgtcctccagaccccagaatggtagatccactggcagcttgcaacacacaccgaggaaagccacaatcaatgccagctcatgaaagcatccaggagggaggctgtaccctgaaaagccgcaggggcagagtggcccaagaccacgtgaacccctctcttgcatcagcatgacctggatgtgagatacgcagtcaaaggagatcattttggagctttaagatttgacagccctgctggatttcagacttgcatgtgccctgaagcccctttgttttggacaatttctcctatttggaagggctatatttacccaatgcctgtaaccccactgtatctaggaagtaactaatctgcttttgattttataggctcacaggcagaaggaaattgccttatctaggatgacactttggactgtggagttttgagttaatgagggaatgagtaaagactttggtgcactgttgggaaggcaagattggttttcaaatgtgaggatatgagatttgggaggggccgggggtggaatgatatggtttggctgagtccccacccaaatctcatcttgaattcccacatgttgtcagaggatccctgtgggaggtaattgaatcatggggacaggtctttcccatgctgttcttgtggtagtgaaagtctcacgagatctgatggctttgtaagtggagtttccctgcacaagctttctttgccctctgtcattcctgtaaaatgtgacttactcctccttgccttccaccatgattgtgaggcttccccatccacatagaattgcaagtctattaaaccctttttgctgtataaattacccaatctcaggtatctctttatcagcagcatgaaaacggactaatacacaagcactgacttctccctgcttagaacacctttccatccccacctgtattttcctccctcatgcctttaccctcttccttctccacaacaagctagtacccagacttccatctaaatatcacttccttcaaaaagacttcatttcttattcctccagatacagattccctgatttactatttttatagcactctgaattttaaatagtacacatcaaaaataaaattaaactattatacaatcataattatgctggtattcctcaaaagacaatatattccaagacatgagccttttcttatgtcttcaataaattcattcaggcctaacagaacactttgcccataggaggtgcttaatgaacatttatggaatttatagttcttccagatgtggttcgactttgcattgagtctaccttagaaatttgtttttcatactcataaagatttcctatttgaccaccacaaaccctctgcactgccactcatagtaagccacacagggagtatactccaaccaagcttcagtacaaattcttccctcagctgtgggtgttctataacatttaattggctttcttaaaatctgacacaaataactaaagactcttgatgctttgtcagagcaaaggagtgtgaaaccattatctcctctaaatactacattatactatactttgtatcatatttctgttaatttagcatttttagaatatttataatacaatgttagttctccctttctgtacttgcgtctacatgttaatatgttcttgagggaaggaaccgagccttattcacctttatataacctagcaagttgaccacatggttggtgttacataacaagccattgaaaataaagcaagcaagcaattaagaaggtaccaaaccctgctcaattctattttgtgggttttgaccccgtgatttagcctatcatgaaaaattctcatcttcattttgaccccccacccagatttgtgccatctgcaaaattgaaaattacccctttgctgatgttatgtaaggtattgatcaattattcagcagcacagaacctgtggtagcttactaattataataaaacaatatttagagttgctggtcacttaatatctaccaagcacctttttaaatacttttacatgtatgtaactacatacatacatgttaaacttaaatattttcaaaacaatcttatcagatggatacaattatcgccattttacagatgaggaaactgaaacacagtatgactaactttctgagggccacacagcttttaagtaatacagctaggattcaaacccaagcagtgcatctcaagatctcagacttttaccactctgccctcctgactaaaatgtgtattctatatacagagctcactctcccaagtcaatatggttattaattcctctgccaactctgtcatatagatcacttatcaccatcttatcccgataccatagaaccttagccactgttttactcaaatagaaataaaccattaaaaaaaaaaaataggtgccacagtaaaagtatgatctcttcaacctgatgagaccatcacaaccagtctcaaaacttcttttctgaagaacaagctattaatttagatgaatgagtcaataacaaacttatcgcagatttaaacatacagaaattttcacggcaaatctgtaaaatatgaggtcaataaatatctaatttatactcaatagcatttatactgttatagaaatgatgcaatatacaagacacataactgtacataacaccctagccattaaatcattgtgcagatggctcccactatcattgtgacttctgtgcctctttccccatagtgtttgccaagccataagctgatattttattttaccttcagttctctgtacattacagcttctctgcctgcaacatccttttcatctggctcctttacatgtcaggtaagttaccactgccccttcaaagcctttccttacggcctgagttttggttcaatgcatgacctgactgtaaaacactatttcccacatcatgtatgtctttccctactcatcacattgctgaagaattgcccatgtatctgcttgtctcccatgataaggacaatgtctttttcctttataacataatgaggagagctcaataatgaaagctcaactttttttttgtatgggtgaatgagtagttctaagtaaatacagtaaatttacttacagtatcaatttcaaagaaattctctcctctaaaaatattgtcttcagacaaggaaaaaaaacacaaaaaacggaacatgactaaaatcttaaaggaagatacggaagtgagcacacaatccttctgaagttaaaatatttctataaattcatatagctgtattctaaatctttttggtaagaatccctgaaatgtattctgaattctaatagatgaaaagttccctgtgggcaggtaatgtgtttactccaactaagagcagcccaacacaggaatatttgctctttgaggagtaatacatgttttataactcaatgatgttttcatattcttgagttcttaattacaaatattttcaaacaatattcaattatttgcttgccaggtataaaatataagttaaatagcaataaaaatatcaatggtttgaatttaataacatgttttttccttagcactatattttctaaatagtattagctacttaattaaacttttcctcaattgggaagtgatcaagaaaatggttgtgtatcaaaaggcagagtaagtgaaaacaagttggttacaggaggaagcagggtatgggtttcgcttgtgctatattaactgctccactggagcaaactaattaatttttcttcattgcactgtaatcagcaagcttaatctagggcaaagaagaatacaattgtgattgcaaatattaaggtcttactacctgtcattcagttgcagtaactacagaaagtctattcaataattaatgtgctatggctattggctttgttttgttattgaatacatttattttaagcagcattaagcgcataaattaaatcttagtaacattttcatataagtaactatcattaaaatgcatttgttccacagaagaaagaattatctcaccattccggctcaacaagaaattcagtcctgaacagacaaaaaagtttaaaaatattttataaacattaacctggacttttcgtagaagaaataaagctgagaacgtcatatttcagcagcttcaatacttgttttctgattgaatcataaatttcattactttatacttgcttctacaatgacaaagtacccaaagctaaatgtgaatgtctagtaggtcagaaaaatgtgtagtcgaatatggtttttgatgacaataaaatcgctaaaaaccaaaagcattcagagagtgtaagagaacaaacacatctcttcaaatatttaaataaccctatgggcaacttgatatgatgtcaatattatatgtcttacgcatctagtttataaaagtcatcaggaaaaaaatacaagattaatctccttgtggatcaatttgggaaacaaatgaataaaaccacagatctacacatagatagagggacattccaaggacaatcactacttcagcctttaatcttctggataactggtgaaagccttggcaggaagcactccaagctacttattaaaaaggtaagaggatgttcttatggatacaatcaagtatatatcaaaccatatgctgtcacttgccccatctacattttcccaactttacagttagaattaagtgatgcaaaacagcttaagagaggatctgatggaaagcaaagtgccctatatccctccacagctcatcactggtttgaagtcaggccataagttcatggtgacatgaaattctcttcaagaccaaattagtcttcgtcagcaagaaattccctacaattcagggtttaactcttaaagagattagctccattttttttctaatttcgaatttacttaacatgacaaattttatatatttatagtatacaatatatcttgataggcatatacatttaaaaatggctcaatcaagccaattgatatatccattacctcacatgcttgtgagaacatttaaagtctattctttttgaaattttcaagcatacaatacattgctattaactatagtcttgttatatacacccaacagttctcttgaatttccctctccaacctaactgaaattttgtgtaaccccattcttaacaagttatatgattcagggatataatagaaaatgttgagacatacacattctatctagttttagcccaactttcaaggctctccagaatttcctctactttgactttataatttttctttcgattctgatatggtttggttgtttcttcccccaaatcttgaattgtagctcccgtaattcccaccatgtcatgggagggacctggtaggaggtaactgaatcatggcggcaggtctttcccatgctgttctcgtgatagtgaatacgtctcacgagatctgatggttttatacaagaaagtttcccggaacatgctttctcttcttgcctgtctccatggaagatgtgactttgctgctcatttgccctccaccatgattgtgaggcctccccagccatgtagaactatgagtcaattaaacctttcctttataaattacctagtctttggtacgcctttattagcagcatgagaacagactaatacagattcctttataggtttattttgaacagtagatgcctctttgtattttgcactgtatcccatcaacccatctctcatttttgctgcagttcctgtttctgctgttagagggttaacaccctttcacttcctagctctagcaacaggaggaggaggaggaagaggagggaggaaaataaattgtccttcaaagggacatttctgaggacagttctataaggttctataatgtcccaggcaaggttgaggtacagttacctattatggtcatcagttcaacaatgttatctttattagcttttccttcttccttgtctcacttttccaggtcccacatgttcctgagttttcttactagtttctttgataatcagccaatcatggctttctgtcaggctttgctttgggggaaaactcaaactgacactcttgactattgctgtcacttaaactgaactcttagagagcagtggtgatacattttaattctttagctttaggggccagagagggaagatgatgcagacttctcaagctcacgcagctctagatggcagagactgcatttaaatccaggtctttctcctccctgcgtgttgctacatgccattttggtacctctctacaggcttgccttccataacctttcaaagttcagcattctcctactcatccaaatgaacacagtagtcatgttttattccatccacttgataaaataatgggtcacagcacagcacttgatccattgttattcaacgaccaagactcttgagttcctgtaattatgtaacaagccccttaactgtcagtggtcataaaggcaagaatctcagacttcggaatcaaaccccccatttactcttactgcaatttgccctcacacaggtattctcaagattacgagataacaaagtgtaagagcttagcacagtgcctgaaacacaggatgtgttcaataaagggtggctattattttcacctggagcaaaacgaccacaaataggggccatgtgctccgcagcatcccctgcctgtctcccaaagccagaacaatgagaccaaataggcgtccacaaacaaaacagacatgtaaaatgaaaaaaataaaaaagataaaatgccctcttttacttcatctgtatgtttttcctatgcccatccctcttctctatttcgaaacatgctctcacattgttttgcaactgggaatactcattttatcttatccaattctaactatctttaagtttcagctcaacttctacttctggatgtttcctattttccatcacagcccttgttgatttctctcatatatttctacagcattcatacactataaagtgaaatttactacttcacaaataattttacttcagacctattgaactattttggtcagtcctgactctcaagttacactgaaagttgctagaaggaaaggatcatttctaatttttctctggggtcctctggcacaatactaaacttatcaggcactgaatgcttaatcctgtagacaaaatgtggaagtaacaaagacaggactcaagaaaaacctaatttactcttctctttctcattcccccttagatgcatttctatattcaatgttcattctgatttccaggtagcactttccccactttctttcctagcttaatcctttcactgctcagcaatatgcggcacacctggcaacatgggagagatgagttagttactgcaaaattgtttgcttgttctcttaatgccttacctcaatttctctatggcaataaggctatcatatccaaacagaagaactaagctaaatggattcatcatttcacaaagtgattctttagcaattttcttattattttatatatttttggtttcatatataatgctacctcagaaattcagatatgcaaagtttaaaactccttttttaaagtttcagagagctacaactacagacgagataagctttagcttgatgaatttcatactgactactggatcttatgtttaaggcagatgcaggtttttcttggggggggggggggggcgggggaagacccaggcaggcccatgtgatacatttcttcaggattctaacaattttccactcagaaagtagtccctcaggaaattattaactgtaaaataagatagaggataaaaaaagaattctgaagcagaaaaatacatggaatcagaagcaaagatgctgaataaatctgcattgaaaaatggaaagttcctattttgtgtttatattatacttttgactcttgtaattattcttcttaaatgtcacaaaaatccccccaactattactattccactgctatgtatgtggagatgtacatacccaattattaggtaacgtacccaaggatcaattagataataaaagaaacattactgtaacacaggacttctttttacactaccttctattaaaaagaggagacataagtatgtgaaatggaatcagtatgccacatagtatttaacagcattattcaattgtcatatttgttagtacctcatgataaatgttaggcagaaagccttctctatctctcttcaccttccagggcaaatatctgccctactttgttgccacagagaataaattttccatgactgcaagctctattgaaaatagaagagaaatggaaaggtccagaatttaaaggaactgtatctctctcccattctactgtatgtcccttgagattagagacatttgtttccccagtgccaatcagagacatgatacatagtgttcaataaatgcttggtgaatgaattggtgaaaataacttatgaattatggttgcaggagggaagaacagagtgatataatgttaaacatattcaggtttacttgcaaggaatgggaaactgaatacttcatatattgatgttgcatataggcatcattatgatcatttggaaattagtcaaaatgtctttaatgcataccttttgatctagctatcctgggttcctagcatgatacctcatatataaatgcacactcgatagctttttgtacctcacataatgacatgattttctataccttgaatatgccttcctcttatttcttcttcattggtgcttttgccttgctatttcacctggaatgctattcttccctatttctacctatcaaggcctttctctaaaatatagcccaaatgtactctccgggcattatttctctctctctctcaagtgattgcaatgcctttttatttgaactctttggactacacttaaatgttatcaactcatgtccaagatgtttacaagtgtcatttgttcctgtgactttaataatgttgtctcctttttttgcagcgtctatttaattttatctcttaccataaacccacctggcctatccagggatttcttcaagaagcacagctactgtatggcacattctacactaaatccccagtatataatctgctcatttagtgataaatcggtgatgctcttcacaggagactgaagagagacactcagaagtcttagaattgtgtgcttctagaatacaaagaatttccacaatcatagagtctgaggacttttaatcattactattttcacagcttttggagtagacagactcagtccccagaaaaatggccaatgtaacttatacacacacatacacaatgatgatgatgattatctttaaatgtgacaggtccacccagtagatttccatgtggaatcaaagtcagatgccataaatgactggagtggcagagtctgtcagtggagttacataaactgtgtgtatggcgagtgcagctccagactgaacagtaatgtgcccgctttgagggaggagagtagcactcctcagtactaccaggatggtgccattgcagaatgttgccccagagctgctagatctgctaacagaaacccaaatctgtagtaaggtgtagatcaaacaaaacatatctctgggttccttccagactttccattaacagtttataacgtcttctgaactatctgttcacatacttaaacctgagtcctcgggctgggcatggtggctcatgcttgttatcccagcactttgggaggccgagatgggcagatcacaaggtaaggagatcgagaccattctggctaacacagtgaaacccagtctctactaaaaacacaaaaaattagccaggcatagttgcacgcgcctgtaatcccagctactcgggaggctgagacaggaggaatcatttgaacctaggaggcagaggttgcagtgaggccagatcgtaccactgcactccagtctaggtgacagagcaagactctgtctcaaaaaaagaaaaaaaaagaaaaaaaaaatcaaaaaaaacaaaaaaaccctgagtcctgactagctctcctgcaggagagtgttactgagttaagcaatcaggagaaatgaaactctatcaaccgatggtcacctattaacaaataagatggcatacttctgtactattgctattcatttatttatccattccacaaacatttttcacctaccatctcttcggcattctcctagctactggctatacagtactgaagccaacggacaaagtccttgacaccaaacattctagtaggggaagcagagaagaaataagctagataatcaaacaaggtaatttcagataatgatgatgattttaaagcaagaagtgtgaataggatacaggaatggctgggagggctcatcaggagagctcttttacatatggtagactgcaaaggattcttctgaagatgagacctttcggctcagactgaatggcaggaagttgtcagctatataaagagggagaagaagtatgttcttgcttgaccggagcctggtgaagtaagggaaccagtgtgaagtgagatcaagaagcaagcaggggacagatcacacagggtcttgctggctgctttcagactccagacatttttctaagtacaatgtagagtcttcagaaggtgttaaatagggaacacatgacctaattaatgtagtaaaaagataactttgtataatgcgaagaactgagagactgcttaggaagttactgcaatattaggaggctatggaatatgatggagtgtcagtggtgcttcctttgaataaaagcagcttttatttttcaattaaaatgtaacataattggtttcagtaaaaatgtctcagttgaccttatttctcctgcattaatggggtcatttatatgatatgtcaggagtgctaccgctgtacacaatgaacagcttttttcaattaaaacgtagcttaattgacttgaaccagaaatgactcttgacatctttgtattaataggaccatttctataatgatcatgctaattaatcttcttcattcaaaagtattgtttattcagaattatttaatacaatcgttatacttttaaatcattttaatgttattaaatattatctcaggatcttgaagtctattggattgttatgctgatttaaagagtgcaaaaatatttatagttatgttttagtttaaagcagtgattaaatataatttgcctgtgaccctgtaggccaaaataatgtatcacgataaactgtagatagtgtcagagatgaaaacagtgtttgtctgctttagtgtattcatatgtgaggatgaattttggcacttgtcagcctatgagaaattactactagactaatacttgtcagtacagtaacaactcatcatgctctaaacaccactaagggagaaaagtgatgaataacatacaaagtaaaaattttcacaatcacattaatgactctagttcaaagcacagtaatggtctaccaaccttattgtccaatctatatttcaagtgtctaccttgatatctttcagaatcaattttacgtcaaattccaattaacatagaaaaaaagcagtagcgataaaaacatgtctctattgacttttccaaaagcaatcgtgctctccaaaccccagcctcatttactattactgaagcaaaacgaaatactaagagtactgtgtgcaaataaaaaacgtttgttgattatctgttaaaaaagaccccaaattaaaaacagcctaaataatgagtattacccgcacacaacaacagtatgctatggatttataaaattatcattcttcctaaactgataacgaaaatctttaaaatgaataaaatgttactaatatatttcacagtatgcactgaatggactacataattccatttgggtttaagttgaggttttttttttttccaactaaatggttaaaaattatgtttagagaacaatctggaaaatatatactcacagacaataggcatacaattgacaattgagcacaactacattaaatttacactataaaactcaatcatccaacacttatgaatccaaacattttctaaaactttacaagaaagcttataggtttttatcatggtaaaatatatataacataaaacatataattctaatcatttataagcatacaatttatcagcattaagtatatttaccttgttgtgtcaccatccccaccatccacctccaaaaattatcttcccccaaaaaacttcatatccattaaataactccccataccttctctcccccagcttctagaggccaccattctactttatctatgcattttactgctctagatagctcatacaaatagaatcatatgttatccttttgtatctggctttttccccttagcatatcatcatcaagattcatccatgctataatgtgtgtcagaactttcttaaggctgaataatattctactgtatacatttaccacattttgtttatccattcatcttcagatggacatttgagttgctccatcttttgctactatgaataatgctgctataaacatgggtgtacaaatatattttgaaggtccttttttcaattcttttgagtatattcccagaagtggaattgctggatcacatggtaattctacgttctatattttgagaaaccaacatatttgtttccacagtgactgcaaggttttacattccctccagcagttcacaagtgttcaaatttttccacatcctcaaccatatttattttctgggtttttttttttttttttggtgttttaaaataatcatcatcctaatgggtgtgaagtgctatctcatttgggatttatctgcatttccctaatgatcagcgatatcgattatctactcatggtcttactggccaaactttagagaaatttctgatcaactcatttattcatttttttaattgctgtttttctgttgttgaattctacgatgatataatttaactgtgtccccactcaaatctcatgttgaattgtaatccccaatgttggagttggtgtctggtgggaggtgattggatcactggggcaaatttctgatgaatggtttagtactgtccgcttggtactattctcgtgatagagagttcttatgaaatctggtcgtttaaaagtgtatgacatctccctccacccctcttgctcctgttctgaccatatgacctgccaggtcacccttccctttctgctttatgtttcctgaggcctccccagaagccgagcagatgccagcatcatgcttcctgtacagcctacagaaatgtgagccaattaaacctcttttctttataatttacccagtttcagatatttctttagagcaatgcaagaatggactaacatataggagttcttggcacagtctggatattaattccctattgaatatatgattcgcaaacatcttctcccattccgtaagttgccttttcactctgatggtgttcattcatgcacagaagtttttaatgttgatgcatttcaatttacctaatttttctgttgtagcctgagcttttagtgtcatatccaagatatttaattgcccaatctaatgtttatgttttcttccaaatgtctacgctttcttctaaaagttctgtacttttggccacgtttacttcctgatccattttgacttaatttttgtgtattttataagagtccaacttcatttattttaaatgtatatattcagtttcttagcaacatttgtggcttcattaaaaaatcattaaaaaaccttggcaaccttatggaaaattgtttgacaatatatagtagagtttacttcagggctattatattctattgttctacattccctttttttaagccaataccacagtgttttgattatggtagctttgtagtaagttttgaaatcaggacgtatgacccttcaacttcattcttttttcaagatcgtttcaactattcctggatccatgagattacatgggaatttttgatagagttgtctatttctgcagaaaaactaattgggattttcttagagatggcactgaatgtgtagtttgttttgagtaactcggatacctcaacaacaatattgagtgttccatttcataaacctggggttccttttcatttatttataaaaataaatgtttaatttctttcaggattgttttgtagttgtcagtgtataagtcttccaccttcttggttaattcctaagtattttactctttttgttactattttaaataaaattgtttccttaatctcctttttggactgcatcactgttagtgcataaaatataacttatttctgtatattgattttatttactgcaattgtgcttaatttattagttctagcaggttttttgtgtggaaatctctagaattttctacatataagatcatatcatctgagaagcttataaaatttttgcatacactctttcaaagctgatttttctgatgaaaatttgaaatgcattgcacagcatgaatatagttaatagagtattgctcatttcgaagctgctaagagagtacacttcaaatgttctctccacaaaagtctttgaggtgatagatatgttaactagcttgatttaattactccacattgtattcataaattctaccatcactttgtatgccatatatttatacaattatatattgtcaatttacaataaaaagaggcatataaaatttgcattctcttaaagtctttaatgcttgccaacaccatttctctgattcaattcaagctgtccaatgccgcattaatacataccattaaacaaaactactccgcattataggcatagtaataggattacatttacctggcttccaaccaaaagcaacaccgctaacattaaaataaaatattctcatcatgaattagtaatttcatattaacagaagctaaaggcacctagtattttttgaggctcatttgcatatgggtatatactcagatttcttttccaaaaaagtagccatttaaagggaaccctggtgtaaaatttagaaaacagatgtagaaaaatcataaaatatccaaataagtttttacaaaattttcctatgctatttcctttatattttctttagtccatctccatttatgaattattcaggaaaaaaaaccccaaaatgattttccgtgttatagaagatcatactccaaaattgaccaaaaagcttcatttgttaagactgtaagttctatatgtgccattaaacatacttactttttctagacttatagtcccaattctgacgtttatatccaatttagagtgtcagactatttcttctctcctctattttagaggcagtctgaagtctttcaacaagaaaattttgtaatgaggtgggtttttttccacttagtgtttgatcaggaacaaagcatctaattacttggagcccattttctcatctggaatattaagctaatgctattttgtcaataggatttttgtaaggattataactagtctataaaacattatgcaagtatttgattctactgtcacaagaaccgatgctttcaaaaatacattaattcagacctcaacaccaattagatatataagcatttatgtgttatacctgatgctcatctatatatatacacaccctactatgtgtctgtaaatctctgtttgggagaaaggtgcaatacaccatgctaaagaatcaattattttcataaaggcttaactattgataagagatatagatataacattgagtgtttcacaggagttacacacacacataactttattcaatttccagcaatgtttcaactaaaaatattctgtcaaagtcaatttacataatggtgagattaaagtaaaactaagaaacgtcagtggataccagtagaatatgacagtttattaattttatttataacacacaaaagaaaaatatgttaaaaaatgaatatgctatcttgcaaacactgtctactatggcagacactaagaaaacttatttaataacaagactgaaattagatttccgtcagatgctgtctttagaatttggggaatagagctattcatccctggatgtgtttcttggagatgtgtcaatatcgtaacaatgaaaaacaaaattgctttataccgttagatatttctgatacaatctttgcccactcgtgggtttcataaagctttgtgccaattttgtcaccaagacaagtgtatctgatctaacacaaattgaacacttttcagcaaagcattgtgtatattatttaattccccattcatatgtcatgaagggaaccagcatggttaccacaataaatttatttaaatcaacaaaattcaatgtcagaatgtatcatttttttctatggtatacttaaggttccattaaatttactgacattccttcattttagaaattataatcccactgggaccacgattttcttaacatagaattgaatctaatggatattttcctcttattgacttgaggtaattaagctccccattgagaagaccaccagatagttttatttatgaagctgatagttcctaactatggcagagacaggctgtcaaacaaccatgtcctttctccagcttttaaagtatagatttttcacttagaagcagccactcagccagccactgcattatccttgtagacaggcatggctatatacatgtttcatgagcacacatccccttcatgtggaaagtgaagggagcacatatgcatcacctctaccacaaggcttctaagaagtcactgtggcttttctgtatttgcttccccctcttcaatggctatatgaaaaaacaaaaaaacaaaaaacatcatcatctgtgaagaaggtagagccacaacaaaggcagaaaaatatagaaaaatattagtcactgtaattagtccattttcacactgctgataaatacctgccgagactggacgatttacaaaagaaagacgtttaattcatttacggttccacgtggctggggtggcctcacaatcatggcagaatgcgaaaggcatgtctcacatggtggcagacgagaaggtaacttgtgcaaggagtctcccccttatgaagccatcagatctcacgagacttaccactatcaagaaaacagcacgggaaagacctgcccccatgattcaattacctcccactgggccactcccagaacacgtgggaattcaagatgcaatttgggtggggacacagccaaaccatatcagtcaccaataaggaacacctacattggacttatacctgggctacatataaactattgttttaagctcctttctattttggcacttatgtgttaaagcagcaaggttgtttagctaattcagtgacacgagatcacactttgtttctgatgatttaaataagaattaatagaattcagttgcaccaggccatcaagactaatcatgcccttggaaagatataagagcagatgaataatttttctgtgtcacctcaaattctgtggtactacagcttatagccaagtgatatattctagttttattagtaaattgagtaaacattactatccaggaaaaaccagaaaaaaaaaaaaacaggaggcttataataaatatgacattttatctttgaaatataaaccagcttcatggaatagtcatctttaagttctaggacagtggcaaagtttttaaaagattgaacacatagtcatcaccaataaacccttacttagtacagactatgcatgaagtactaaggtaagtgacttctgtaagataaaaacatggaggaaacccttttgtggttcaggaacatgtattcccaaggttggtgtaactgaaggttagtttaagaatgggtacagaacacatggtgggaagcaataaaaggcaggcatagaaagccggattttgtttagaaagaacatggggttgtattaacaagagaatgacatgcttagacctgtcatcttcaaacactaattgtggtggcatgtgaacaatgatttaaagtaggaggaaattagagactggaagacaagctaagagagggaactgtaattatctgggcagcagttttgggggatcatccagcagagaatgtagaatttaaagtaaattcctctagtattgctattcggaatagaaaactacatttacaatgatttaatacaatatacattaataccaaaagtatagtaagaccttagatgtaaaatgtttacgtgttcttggagttccttttctatgcttgatgatcaattgatgtattaattttagtttttctaacctaaatgtatttgagggcgctaattttgaaagcaatataaatatgtcgattactttatgagttgcataaaattatatacattagtacaataccaaatgtacatttggagagggaatacagattctattagtaatttaatcattcatttatgtttttcattaaacatttaagttcctactgttttaggaccaggagatatagcagtgaataaaatgtacaaagtccttaacttatgaagcttaaattctaggactagaaataaaaataaggacaaataaatatgctacacaaaatcaggtcatggcaagtcctataaagaaaaatagagcaaggtaaagagagggaacaaaaggcatggagaggttggctctacttaagagaggatttagagagggaaagcctttcaactacaggaacatttaaaaatagagttgaatgaaataagcagttgaatcctgtgatgactctctggagaaaacacatttccatattaaaggatcagcaagtacaaaggtcctgaggcaggacctctctggcacttgactcccaatgagcctggatctgactagaagtgaaggcatggagagcctatgattagcgcatgcaatattaattttgattacaaagttactttaaactggattagctttatctccagtgaaacacttttcagagaccacagacaaatcttttggactacatctaaacattttttggaaggattaatatttctataattttgaagccatgtgaaaattaagatgagtctattctcatttagtgatcatgccagccttagaaagactgaaactgattaagtaaatgaaagtttgtcacacttaaggtgtaactactacagatgaaaacagaagccactacaaacctagcaaactaagtagatttctaaagttttcagcaagtgaaaacataaatgtcatctcatcattgacaaattccctaatcccattttgttaatacacacacacacacacacacactctgccactactccttctgtgccccaatacggcttttttcaaactactattatatcaagggctgtgattatgtctttgcaatattttcagtgtctcacccctgaaagatgcataacaacaattggttaaatataactaaatagtattccctgtgatgactctccaaaatatacgagtttctgtaccacttttgctatttcagaggttgactattttaatgctagagccagagacacagtaatccaagtgacatgctcaaactaaaagcactgatcaagaatgagaggattttgttttatctttgaggtttatacattattcttctcaaggatgggctcaacatctaagtatcttacatgttaaatgaaaccattccaagtcaaaaagataaaaataccaatatatttatatagagcactaggaggtcctaactaagccagtgattttgatactctgactatgccatagccaattcaaggagtaatagaaggaaacacctgaaaccggtacagaagaagatagaactagaagaatgggctgtcaatgcctaactgatgagggcattggttggccattcataatttgaaatggtaaatcactagctatttcctaaagcagatactgctgtaaaagtttctgatttctccctgaggtcatttaaacaggtctttgcttcatttttgaatgccgttattaattcatgacatattctactatatgcacttacatcccacaagatgaatctcctttggagggcctattggcccaactactaatataagtcattgttagtagaattctacatctccctttcctaaccttttctttctacgtttacaagggggaacagcaattgaattaaaataaacatcatttaaaaatcagcaatagcatgagttacaataactagtctttactctgtactatatgaagtatttaacatacattaacccatttattattaaccacattgcacaaatgaggaaactgacgaactaattgcttgtgtaaagtttttaaggtcacacatctggtaggtagcagagctaggattcaaagacagtgcagctcaagagcctatgctctttactcttacatagaggtagacgttttaaagggacaaaaatattctgagttgatcatttctccctatgtaagtgaactaatatatcactccctaatcaatccctgtatcctaaagagttaatataggatgtaatataggatgatctaagaactcggatacaacagactcccccctatatcaagcaagagtcccttatgccaagcataattacccgtgatggctaacataaaatcgtttggggaaaataaacatatcaaattgtttaagctcaagtagatttacagaaactcgggcaaactcatgtgttccaagataacaccacagactgtcacagcaactcatctggtaagctaattctgaccaatctgtcgagagcatacttagaaccatccagctcagcgtgtaaaactcttaagtatccttccgtcatgctcctcttctgagaggctatgactattccctgaaggtggtgcttaccctttccctgtaaatttaacaagctcagctttgggtgatcaacacctttgactggaggacattacaggtgtttctatggtattcattcataaactaaaagtagagctgactgaaagcctggtatttatagctagcgagagaaatgtccaattattagatgaggttcattttcgttaattattttagttattatgactacataatagttgtacatttggggtgcatgggatattttgatacatgaatacaacatgtaatgataaatcagggaaattagggcatccatcacctcaagcatttatcatttatgttagctaaattccaatttaactattattttgaaatataaattattggtaactataatcactctagggtgctaccaaacactagatctgattccttctatctaactatatactttttatttttttttttttttttacctatttaccactccctccttatcctgtcctccccacttacccttctcagcatctggtaaccatcatcccactctctatctccatgagttcaatttactttagctcccacatatgagtgagaacttgcaatatttgtgtctctgtgcctggttgatttcacttaacaatgtcctccagttttattttctattatttttctttctctcgctctccttttttaaagctcctctggagtgctctttcttagttttcaatactatattttctgaacatgttttttaaaatctacatctggcatctgatctattcctacaacctatccatattctgtctgacctatatttttatttatactttaattccatttgaatttctgctctgggctttagtttacacttgcaatgtgtgatatctgatatctggcccatcctggaacagaagaaatatatcattaccaatggaaaaacacattaaatgataggaacataggaaagtcggtttaagataaatgggcccctagaaagatacactcgcacaacagtatgtacattatataaagatgttaagattagggatgtctgaaattccttaggagaaatggcctgctaaagggcaagggttccacgattgtaatataagagagttattcaattttactaaaaataagttaaaatatttttaataacgtaatcaacatttaccaagtaccccttctttcaagtaatgggactaagaccggagggaaagaaacaattcgtaagatgcaacttctccattaaagctgtttaagtccacagtcaattacactgaaacactgattccaagagcatcttaagttaatctggatttattctttctaggtagttctatcacttagtatacttatgtattagtccattttcacactgccataaggaatacctgagactgggtaatttagaaagaaagaggtttaattgattcacagttccgcatggctggggaagcctcaggaaagttaaaatcatggtgaaaggcaaaggggaagcaagcactctcttcactaggtggcaggagggggcagggaacagccagacacttaaaccatcagaacttgtgagaactatcatgagtgcagcataggggaaccacccatcccccatcccccaaatgatccaatatcccaccagttccctcccttgacacgtggggattacaatttgagacaaaatttgggtgggtacacatagccaaaccatatcattctgctcccggcccctcccaagcctcatgtcatcacatttcaaaacacagtcatgccttcccaacagtctcgcaaagtcttaactcatttcggcattaagtcaaaattccaagtccaaagtttcatctgagacaaggcaagttctctctgcctacaagcctgtaaaaccaaaagcaagctagttacttccaaggtacaatgcaggtataagtattgggtaaatgtttccattctaaatgggggaaactggtcaaagcaaagtagacacaggtcccacgcaagtttgaaatgcagccaggcaatcgttaaatcttaaagctcccaaatctgccttgactccatgtctcatatccagggcaggctgatgcaaggggtgggctcccatgaccttggacagctccacgcctgtggctctgcagagcacagcccccatggctttcacagtgcctgcagcttttctaagtgcatggtgcaagttgtcagtggatctaccattctggggtctagatggtgggcctcttctcatggctccactaggcagtgccccagtgaggactctgtggtggggggaagggctccaaccccacatttcccccctgcattgccctagtagaggttctccatgaggactccgcccctgcagcagacttctacctgaacatccaggtgtttccatacatcctctagacatctaggcagaggttcccaaacctcatttcttgccttctgcacagccgtaggcagaacaccacatggaagctgccaaggcttggggcttgcaccctctgaagcaatggtgcaagatgtaccttggccccttttagccaaggctggagctgaagcagctaggacacaggaagccaggtcccaaggctgcacagagcagtggggccttgggcctggcccaccaaaccatttttcccttctaggcctctgggcctgtgatggaaggggctggcacaaaggtctctgacataccctgaagacgttttccccattgtcttggctactaacattctgcttctctttacttatgcaaatttctgcagcaggcttgacttactccctagaaaatgggtttttcttttctgccgcatggacaggctgcaaattttccaaacttttatgctctgctttccttttaaagaaaagttcccatttcagataatctctctgtgaacgcatataaccgtatgttttcagaaaaagtcaagtcacatcttgaatgccttgctgcttacagatttctgccagataccctaaatcatctctcaagttcaaagttccacagatgtctagggaaggggcaaaatgccaccaatctctttgctaaagcatagcaagagtcacttttactccagttcccaacaagttcctcatctccatctgagactatctcagcctggacttcattgtccgtatcactatcaacattgtggtcaaagccattcaacaagtctctgggaaattccaaactctccctcatctttctgtcttcttctgaccccccccccaaattgttccaacctctgccagttacccagttccaaagtcacttctataattgctatatttatagcaatgccccactatctgggcaccaattttctgttttagtctgttttcacactgttataaagagtacctgtggttgggtaatttataagtaaaagaggattaatagactcacagttctacatgggtggggaggcccccaggaaacttacaatcatggtggaaggtgaaggggaagcaagtaccttcttcacagggcagtggggtcggggggaaggctgtcaaatacttttaaaccatcagatcacatgagcattcacacactatcacaagaagagcatggggacaaccgcctccctgatccaatcacctcccaccaggaccctccctctacacgtggggattacaatttgagatgagacttgggtaggggacacagagccaaattatatcaacttattaatgcagaataaattgtttccaatacaatgagaaattttccctaagtttttctatttgtgacacctcaaaactaaaccactgatgttctcaaatgcttaattaattaaacaaactcatccaaccaaaaatatgcttgtgcatgaaagctgatgttttatggttacaaaaagtaaaacaaaatagtatgaaataaggaaaacatactgcattctatgcactgataaaatgaatgaagctaaatgggtcataaaaaagtatatccagttttatagggcgtgaggcctatatagcagcataaatttgtcttttttttttgtttttacagtaattaagagtatgcaacacgctccacaattatctgagtaattagattttctcaattaaaaacgagcactgataagattagctggatttctaggtcactttgtttcgcagcattatcaatttatccaggtcagaatcttacatctagggatacagactggactggaagttcctagtttttaagtttggtttctggttggggggggaatcctaccaagctaggaaattaatgggaggatgcaattgaaataactaggatagtacttaatgtgttgtaaataataatggcagttattactttgtaaaaacatattttaagcaagtatggaatttctcagaaaacttaacctcaaagcaaaaattttaagattgtttatggtaagaatttaatatcattttccatgtattctcattcttactgttattatttcagtcattggggaaagttatgcttccttcagatggggtgattagaataaacaagaataagacctctgaattcaggacttcgcagttttccaaaagaaatcggtattttttaaacttttaacagattactcctttctattgagcaaatctttacctttccaattggtatttagacatgtaaatttaaaacaaagacattcttctgcaaggaaatttcagatgcttccataagcatttgaaacagcccaactgtttttgcatacttaaggaaagagctatcttaaggatggcaacagttactgtgtaaaaattttagaaatccttttaagtatcaagtatacattcttatgccctgtgcacatcgctgctcaattttggatgtccagcagtgtgcgcacgtccatgtgtgcatgcacataattatatacccatgcacatgagcacattcatttaaccatacaagaagcaatcccagcaagaattctaaaaaactgatatatgtctgaatattactggaaaagagactgtaggtgagacctgggcttcatatggttcaacatagatttgtcagttgatgctgttaattaaaaataatacagaatatataggacaaagtattgtgtgttgatgtaattgtcccatgactgtgccaggtaagaagcgtagaggataatattccctgaaaacagtagggatttctactgctaaacatcttttaaaatgtcagatcctcgcaaaaaaaaaaaaaaaaaatatggactttcgtctagggtgagggaaaaagtttttcccttcgtgccttttgtgattcaagtcccgaaccctatagaaatgagcactgctggacttctaccattgagggcagtttgtcaggccccaaagctgaacagccaagtacaacagaccagagctaagaaactgaacagaaaaaaaactacagagagtgcagtagtattcaattactgttgtaacatattcccaaaatcttaatggcttaaaacaagacaaatgttttatcttacagctgagtaggttagacatctgacatgagtcttattagactaaactcaagcaacagcagggctttgttcctttctggaaattctagaagagatcatgtttctttcccttttctagcttttatagacctccaatattccttaacccctggtcttcctccattcttcaaagcgaacaacagtaggtatagtctttctcaaattatatcactcaggcctactcttgtgcctctttcatttttaagcattccggtgactacatagtgtgcactcaggtaatccaggttaatctccctccctattttaagatcagctaattaacaaccttaattcccctgtgtcatgtatcatgtactatactcacaggttctagggatttcgacatgagtatccttggggagccagcatccaactaccaaaggagagtttaaatatgcaggtttaaacaaaaaagtcgtatcatattgagtatccagatttcactttgtctccgatatactctaattctggtattcccaagtattaaatatcttgggcaccaattatttttgtaaactggtgcctgtaataaatttgactaaattaagctgattatttaagctaattgttcatgtatgaattatttcatcattccactgataggtggcacagtagctcacacaattccaagagatttagtttcaaatgaaagtcgtcctattcatcccctttattattgattttactgcacacacacagagagtcattactagatgggaactgataacaatgttgctcggacacacaatgacacctaatatttatattaatatgctagcacattttttctgttcctattttttgatagctgcaaattagtcttttgtcgcacattccctttttcatgaggtttttaaaatgtttaataaatcatctacatatttaatttttaccactagcatttagacatttttaaagttatcttttgaaactaaattatttttagattttacagatgttcccccttcctgtgtccatgtgttctcattgttcaattcccacctatgagtgagaacatgcggtgtttggttttttatccttgcgatagtttgctgagaatgatggtttccagcttcatccatgtccctacaaaggacatgaactcatccttttttatggctgcatacggcctgtggtggggtggggtggggtggggtgggggtatgggggagggatagcattaggagatatacctaatgttaaatgacgagctaatgggtgcagcacaccaacatggcacatgtatacatatgtaacaaacctgcacgttatgcacatgtaccctaaaagtataataaaaaaatcaaaaaaagaaaaattttaaagattactattcaagatattcttgggaaaatatttaaattataataatcccaatttaaattatactttaattatgtggtcattttatattttaacttgtcatgtatcttctcccatacaagcctgatataaattttacatagaaatcatgatctgtgtatccatatacttctcccctcatagtacacacacttacccgatatgtagtgtgtattgctttagcatactcaataaaatccattgagacaaaatatgccttatgtttctaattgtaacagtcaatttttaccatataaattaccaagaggatttttctaaaattatacgatgaatgtagcaattacacaatctctctacaacttttgtaccatacatggaattctatactagaagccgacattcttatgcccgacagaactatttagttcattttatgagacgtgctattgagttttagataaagtttgaaattttataacagcttattctgtaagaatgcatacaattatcaattaccttgggaataaattgttttacatatttctgagaaccttctgcagcttcttgtatatcaaaccacaggtatatgttttagcatagttaatattttttgaaattaccttcaccactgttattttatttaaataaaggtaatcaggaaggcctttcttcagcttagacaacaaagtagccagtaagatcaaggaaaatattaggtaaaacccaaatacaacttcaatacttggatactgaccatttcattgcttgttaatgttaattccttggattaatcagttaatttaatctatcagcttgataacgtatctgatcagaactttaaaatcctaactggtcttcacacatattaatgaccctcacactttcatgtaatatgctaatgtaaaagccgtgtcttcaagaaacatttgttgtacattaaaaaacaggcactcgcactttcagaggccgaggcgggcagatcacgaggtcaggagatcgagaccatcctggctaacacagtgaaaccccgtctctactaaaaataaaaaaaaaataaaaaaaaataaaaaataaaaaaattagccgggcatggtggcaggcgcctgtagtcccagctactcgggaggctgaggcaggagaatagcgtgaacccgggaggcggagcttgcagtgagccgagatcgcgccactgcactccagcctgggcgacggagcgagcctctgtctcaaaaaaagaaaaaaaaaaaaaaaaaaggcactcttatgctctgggaattcagctgtgaataataaaggtcccagcacatgaggaagtcaccaccaataacaggactgaacaagtctacaactacctacagcattgtgataggccagcagtactatggtgggaacaaactccactggaacattaagtgagaattattttttgaaggttaggaattttacgttggattaaatatcaatgatacaatcaaagtgaaacatgagaaggactcatactgttgtttactctgttaatattgtactaaacagtattgaataaaacaaaatcaacgaaacatttgaaaaacagaagacattgtatctttaaactagtgatgtcattttcttgcattctcatatataactcaatataccgggaacactgtagattctaaataagtattatgtaattaagtaaataaattctcccttgcctctactccagtaatccctcttcccttgctgctgcttgtgaatgtgtcagcctctctcctgcaaccaaatttctaccccagacatactacattcgtcttattccatctctccatgtattgacaagatgggcacatgagtacgtgcacacacatacatccgcatactaaggcaaagtagcttactttacctatctcagagagaaaactagcctaaacataaggaagaatgctcactaaagattttaagatacagataaagaacatttgagtcacctttaagagacataaattacatgttcactccactttctctctatttccccaaatatatggtattctcctcaaactaagatagcaagatatctcagttgatatcttaatacactcagtattcatgtaggctcccaggtaagaaaaaaattattattgttgcttgtctaatcctagttgcatttaaatatgaaatagtaacatggtaattttttagaataaaaaccaattttgaatacaatctaatgaaaactttgaaaaatgttcatttccaaagataaattaaagacagataatttcacagatcatgctctcccttaacattaaaaaggttcttttctcatatatgtattaaatattatcattaaaaatcactagaatatcaaaaaaacagcctacagacttggtgtgtatagtatgtgataacataagcacaaaacaaaacaaaaaactaagaatagtttcaatatgtatgcagtaacagagacacatgctattctgagaagggttaaatcaacaaaggacataatctttctggggttcagctgtgaaatgcagagtggaagaacaacatcccagggagttggaacagcaagtgctaaggccttaaactatgtaaatatcatgctagatgattgtgtgtaaaagagaattaagttaaatccagaaagaaaatagggccagtcattgtcaagttcttcctgcagtcacagaaaaagatgagaataacttgaactatggtggtggttgtacaggtggagaggtatgaatgatttagtgatatacagtgggccctccgtatctgcgggttctgtatctgcaaattcaaataacctctgatttgatacaatagggtgaatatagtcaataattgtgcatttgaaaataacttcaagagtgtaattagtttataactcaaaggataaatgcttgaggtgacatgctattctcatgacgtgcttattccatattgtatgcctctatcaaaacatctcacgtaccatatatatatacacacacacgtatatatatacatatacacatatatatcatatatacacaaacaccccatgtacccacaaaaattatatacacacacacatacacacacacatatatatacctatatggtgtgtgtatatatacacacacacgtatatatacatatatggtgtgtttatatatatacacacacatatacatatatggtgtatatatacacacacatatacatatatggtgtatatatacacacacaccatatgtatatacatatatgtatatatatataccatatatatagatatatggcatatacacacatatataccatatatgtatacatatacacatatgtgtatatacgtgtatacgtatatacacatatgtgtatatacgtatatacacatatatggtatatatacaccatatatacacacatatatgtacacatatatggtatatatatacacacatatatatacacatatatggtatatatatacacacatatatatacacatatataccatatatatacacacacacccctagtatgtacccacaaaaatttccaaaaaaaataaattgtttcccaaataaaaaaatattcaggaaatacaataaaaattaacaggatagaaatctccctgttgggtactatgcttattacctgggtgacaaagtaatctgtactcagagcccctgtaacacataatttatctatataacaaaaatgcatgtgtaaccctgaacctagaaattaaacacaaagaataaaatgtaacaactatttacgtactatttatattgtattaggtattataagtaatctagagataatttaatgtaaacaggaggatgtgcataggttatatgcaaatatgacatcatttatataaggaacttaagcatccacagattttagtatctggagttcctagaaccagttctcagatagtgaggcacagtcgtattcttaaagtataatctataaggcatcatggattgaaatagttctaatacttcacttttttcatacttaaagctgcttaaatgaccaacttaaaagatagatttattattacagagatttcccgatccaagctattaatgtcagtgcagacatggttgattcatggagcgggggtgggggggggaaatacacacctggaactcatctgtgtgtttagaggacaaattaaatcatttttaaatagccccaggatgatctcagccattaaagagcagaaggctaataaaacaactgttcctattaaatcgttttctgagttttataagtagatgtcctcccttatgtattttattggcaatatatgttacctttatagagaagcagcgtttctatagctctcaaaaaggttaagaacccgaggtgtattataggccaatttctcttgtaaatgttgacttaaaatagtttaaagagcattttctcatgttggaggtgattaattgcactgagtttcacttgtaaaaatccattgctcaaacctaaggatggtggggggacacccatctgtgcaaacgtgtggacttacaatgacttttgcttatgttagctcaggtgtcagttctaatgaacaactttcaacaagagaaaataaatccagaactttttattagaaatcacacatgttaaacagaaatcattaactaaaccttactcaaaatagtggtggactttatcacttaagaaatcaattaacttccaaggaactatagaaaaagttaggttcccgctccaaaatcatcttatcgatttatgcatttatgtccaactaataaaattagggaagcagagtaagaactactgtatggatccgtggattttggtatatttaaaatcccatataagaattatgatgcagccacattttcatttgacataaatatttgtacatttattagaatgaaaaacatgctctgtactttaaaaaatattctctgaattagttcacattctgtcttatataacagttacctatatattgtttgttggcctatatgcaattttcaataccttggcagactgtatatcttttacttcctgacacacttggagtatatagcactattccttatgtaaagttatcaatagacatttgatgaattaacatgcatttctactgaacaaagtaagcctggggcacataactttaaaatgcttatgtagcatctgaaagaatttacaatgtcagactaagaataaaaagtaggggctccagaatttctactttattaatgatgtggtcaaatcaacccattggaaaaaatcttagtctactcagccacctgcacaaatgctcgtgctctataaaagcattaaaaaaaaaaaaccttttagactagtctatatgtactctgcagagtaaaagacacattagctaaaacaatagtgctcataatattaatgtatttggcttgtgtaagtaacaatatttaagctctgacaataattctaattttaaacattttcattccatctgcaagattaaagtttgaattattatgattattcaatgcctcttgatcaatctgaggaaagatttctttcaataagaacattccttcaagcactacctttgctatgttcttcactagtctatgttaagattaacgtgaagaaggctaggtaaggagtattatcatttctattataatgattttgcttaaaatgtacatttctgtttatgatgaatgcaaagatattatcatttaatggaaaatttatgtaagacagatctcgctacaactagctttagcagttttacttaggttataacaatttaaaaatttctcatcttatagtcccttaatattccatattttttaacttttttcgtatttcacatgcagtttgttggtgaaagcaaaattcgagatataatagagagaaaaaaatacattatttatttttatccaggagcttatgtctcatttttatatcgttgttatattttgcaatgggtgaaatttgtctttctcttcagtcttttaaaacctagttacttcaccaggttttttccaaatactcaaatgcccaatcgttatttttctatactagttttttccccacttctggctgtctcttttcagagtccctttgattaacaactacaacaatatcatagtctgctgtttaactacagtgaggtgaatttattaagggcttcaccatgtactcttgcctcttgaggaggaataagagtgtgtgtgtgtgtgtgtgtgtgtgtgtgtgtgtgtattccaattattaataaaaacagttttcaaatcacttttccaagagactcacttgcccaactgattctatacagaaaaacttagatattaaagcctaggtaaaatgtatctttttatttagactttctcagataatagcttttttttttaatccacatatgactcaaggtgggatttcaatctagataagagatgttcacatcacgacctcactgaggaaatatttgagatagtgagatgttttgatgcctttgccatctaattttagagttaactgagaaagagtagaggggaatattttcataactggtgagtgtctccctttgataactttagtgtggcttggatagaatgtcatacttgcaagatttgtaaacatccttctactttaattatttaatgattctctcaaggaaacatcatagtaaaaagaattcagtatccctcttattctggctctagtttataaaacttttccatttattttcaaaacatttggaatcaactgatggatgtgcatccaattaaaaacaaacccaattagccctgtaataaaatgagtaaccttttagttaatgcaaagaaaatattcatggaagaagagaggaatattctgccataagattatattctgtagtagttacaagtagggaatcttaactccaactcactagctgagtgatgtgggcaatttacataaactcttcagttgcaaatgaccaaaataatagtctctacctcctagagtttttgcagaaataaaacgaaattatacaatatcaagcaatgtgcccagcacttaatgtttaataaatatcacaccagattacatcaatattactatgtatgtattactcccagcttcagaagttgagtttttctgagagtctgggaaccaattcaaccacttttacgatgtcatatgacgtaatgactacaagagaaaacctagttatacttttgcaagtgtgctaactaatgtcttacaaatactatgacaattataaggtactatcatgaaccagccttcaggagacttgctagaaatctaccatgtatccatgacaactgtgaatcaatctctctgtcaagtgtgtgtgtgtgtgtgtgtgtgtgtgtgtgtgtgagagagagagagagagagagagagaaagagagagagaaccactctgaggaatttaagatatagtataaatcttttatgaaaactagattagactctggagctcaaggatatcaaagattaccacccagtacaccagctgtgagccagcagtattcctcagaccagaaaaccagaatgagtgggaaggtcacaggaagaccagcaagatttcaaatgggaaatgacagtagatcccccttttccacgggggatatgttccaagacctacagcagatgtctgaaaccacaaataggccctatatatactgtttttcccatacatatacatacctatgataaaatttaacttataaattaggcacagaaaaagattaataactaatagaacaattatagcaatatgcagtaataaaagttacgtgaatgtggactctcacctctccctgcccaccctccccaccatcatctaattgtactgtactcatcaatttaaggaccacggttgaccatgggtagcagaaactgtaatgaataagggaggactcctgtatttaatttggggagagtcagcatttattctagaggcaggcaaaataactggaaagatcagttttccctacaggagtataaagggaccatttaatttttacaacattccagttatttgacataactttagctactgtttctgggctcatattacgggccaaatacatacaggttttacttactccttgaagtagcagtgggaggtaaatatttttactttacacgtgagcaatactgagcctcaataattttccagtggcctaaaactaataaaggcaaaaatcagattttaacccaaaactagttggctctgtgtagaaaaagttaaatcaaccctaggttaatctgatgctgcctaggaaaatgaacatagaaacttattttcttaggattaagagttaagataatagtagaatttcttgtcactcttgtttgctaggtaggactactattaaattaactggggagtggggcagagaggcaatatatagtcttttgtcctatgtgacaacaatggtattaaatattggtgggaaattaatgctgcaatttcttcatgtcaagtaaaccacactgattttggccgttgtcctagcagctatatggagcacatttgggtgagaggcatgtggaaatctgtatgttggttgcttctgggccatccaatgatacaaagattctatgacagtgtatctcctgccttgtatccttctgtacagctaagtaaatgtcatagattaaattctattccatctgtgagtataattgccaattttatctccttacaactacactaacagtgcaggctccaaagttcattatgtcctgtcagtaaaagttgcatatctggctaaaatacaaactgtttagcaaaactaaccctggataaatggtaaataaattcaacctatttatggcattaatatcagagatcataaaattaagccatttgcttatttcaagtggatttatgggatcagacttctaatttgaaaactattattttaccatcattttaattgttttcccttattagcccttagttattattaaaaattcttctagttctttatcagctctgccaatgaaagacatttttattggctgcaaaaggcatcaacaaacctcagatagcagaacacagtgatgtcaattagtaacaagatgagagaggcaggcaaaagaagaaataaattaaagaacaaagagtcagggatcacctctgcaaacagctcctctcacctgggcaacccttgctggaaactgtttgagtcagagtaccattctatcacaaacatgtccgtgaagcaataaatagaagaaggaatgaagagagacaactgtgcagacaggagataaggcaagtttcttaatcctaaagagaatgttttgatggccagtcttatgtgacagctagtctatttttactttgtctgtggatgaacaatttctcattaacagaactgttagcaataagcagtactccagtaattgaagatgtgaacagcaggcttagtcattttttaaggaagaaaatgctagaagtctaaacaaatgctgggacaacagattctggatcttatcctataaaagggcatatctcacagaaacaattgttccattgtagttgtttctatcttagctgcaggatactctcacttactgagcttctaaaaattgctgatgtcacagcccgtcctcagtgaaataaaatactagtttcaatcccagtgttgccataaagcttccccaaccgattttattggacagtcttgtgagaaataacacggactttaagaagagataaaccctggatttgattatagctcagttatctattggctgtgtgatcttgattttaataaagctctctaagcctcagtttttccatttataaaagaaggataaacttacctggaattgttgtgtacaagacataagataaagtatggaaattatctagaacatgactgccctacttaaacatttgcactcttctaccaaaaggaacttgcaaatttgagtttatatcactgatgataaattagaaaaatctttgcaggggaaaaatgtgctttgatttgaagcaaaagtttattcagcaatattaacatctcacaagaatgatattacaggatatttcctaaaagtaaaaacactggtttcaaccaccttattaaattgtaataatatataaaattcctaataatttaatagttgtaacagttttctcacttttcaactggatatcatatgatccactaactccacacgattgccataagacaaaaaatctggggcttcaaaatggctgaattgatggatctgttactcacctcttccatggagaggaaccaaagtaccaagtagataatcatactttgaatacattaactaagagaaaacactgaaattcaacagagaagcaatgaaaaccactaaaaggaaaaagaaggaaatgaggcactctatccagctgagattggctaggagtctggagaggctccctaacatggggagagaattagagatgcacaaaggtacacattcttgtacaagattcctacaatcctagccaattgagagcccttcaacccgtgtgggcccccaaaccaacacacagctgtctagatactgtgcaaaggcattgcttcacggaagaagcccatgctgggttccacaaactctagagtcctaagcagctgcaacatggcctggttttgagagcccagcccccaccagtctatgtcctgacctaggactaaaaatcttccctatctccacattcctggagtctcagtgatatttcccacccatggctgcaactgctggggccaaggcaggaaccactggcagcaaaccctcccctgcccaacagaggggtggccactcaacttcatgcacactgaagactaattccactgcctgcaaatgctgtcactgtgaactgctgtggagttgagacacaagcgacgcacaggctacccaggcaactgcttatggctgctcccaaggaaagcaaccttaccctctccagtagcagggccacagtgtagccaacactgccttccacctgagcattgcacaagggacctggggagcaccttgcccctcgactacaataaccagtggttgcatgcaccaccaggagtcctgaggacaggtcttcccagctctgctcttccaaatcccccagtacataaaaatttgtatagagacctggggctctcccaccccagtttaccaccattggcatctgactagtcttcctggggcctgaatttgggcccactcaagcttccactaccaccaaagctggcgtcaacctacatgcaccatctgcaggcctaggaactggcttgcccaatctgttgcatccaccaccaacaccatcatggattgcttgcattccagagggttgcccccctcccactattgccattacccgcaccatgcttgctgcccctgggctgggaacctgtgtacccacccagcccacctatgcttttcctgacaaccaagcaagccacctataagccaaagggttagcctgcctggacacactaacatcaatgccaatgtacacagctctgaggcctgaggacaggcacgctcaaccaactgatgccaccactggggcctgaagactggaccacttggtgtcccagtcaccggcaaaacttcaccacagcttctgctaacaactgcaccctaagctactgaggaagttacagacaccattcatactgtttacatccaaagaaatcatacaggaagtatactactatatacattcagaatcaaaggcaaagactcaagaggagactagataaaacagaagaatctcagaacatgaaaacaggtcttttaaaataacctactcaaacaaaaaataacaaaaaattttaaaaaaatgagcaaagcctatgtgacatatacaacaccataaagccatgaaatgcttgcattttttatgtcctagaaggtaaaggagaaactaaaggtttagaaaccctatttaacaaaataatagatgaaatcttcccaagtctagcaagagatttagacatccagatacaggatgctgaaagatctcaaaaagggatacaattcaaaaatgtcttgtccatgacacattatagccaaactctcaaaagccaaagacaaaaagagaattctaaaaacagcaagagaaaagcaccttgtcacttataaagaaacctccatcagattaacagtgaatttctcagaagaaaccttacaggccagagaagaatgagatgttatattaaacttgctgaaagaaaacaaccaccagccaaggatactctacccagccaaggtagccttcataaatcaaggagaaataaaatagttcctagacgagtgaaagctgtggaaatttatcaccatgatactggccttacaagaaaggtttaagggagtcctatacctggaagtgaaagaatgacaactaccatcatgaaaacacataaaaatataaaaacaactagtagtgcaaacacacaaaaaaaatcaagaaaagttactcaaatgttaccactaaagaataccatcacactataatgataatgagggaaaaaaatgaagaaaaaatattcaaaacaaccataaatcaataaaatgaaagaaataagccctcacatatcagtaataatgttgaatgtaaattgattaaacattccacataaaagacataaactggctgaatggattaaaaaatatataacccaaaaatattctgcctaaaataaactcatttcacctgtaaagacacatatagatttgaagtaaagggatggaaaagtatattttatgcaaaccgaagccaaaggggagaagcagcagctatgcttacataaaacagactttcagtcaaaaacagtaaaaacaaacaataaggtcattatataatgataaagggataagtttagcaagagtatataaaaattctaaacatacatacacccaacacgagagctcccagatatataaagcaagtattagatctaaagggagagctagatgcaaatacagtaatatctgaggacttcaacaccccactctcagcattagatcacttagacaaaaaattaacaaagaaacattggcttgaaactgctccttagaccaaatagtcctaacagacacttataggacaattccttcaacagtcatacacatttttttctcataagcacacagaacattctccaggacagaccatatgttatgacagaatatgtcttaacaaatttataaaaaatcaaaatcatatctaatatcttcttaaaacacaaggaaataacaaaaagagaaactttggaacctgtacaaaaacatggaaattgaacaacatactcctgaatgaccattgggtcaaggaagaaaattgaggaaatgttttcaaaaaattattgaaacaaatgaatatcaaaatataataacacctacgggatatggcaaaagcagtgctaagggggatgtatatagcaaaaatgctcacatcaaaaatgttgaaatatttcaaacaatctaacaaagtacttcaaggagctagtcaaagaaaaaaaaacaaaccaaacccagaattagtagaaggatgaaaatcctaaaaattgagcaaaactcaagaaaatagagagcaaaaaatacaaagtatcaatgaaatgagaagtttgatttttaaaaagatgaaaataaagcacttgctagactaaccaagaaaaaaaaaagactcaaaatcataaatgaagacggagacattacaactgataccatagaaataaaaagttcagagactatactgaacaactattaaataataaactaaaaatctagaggaatgtataaattcccggacacatacaaccaaccgtggatcaagaagaaatagaaaatctgaacagatctataattagtaatgatcttgaatcagtaatcttaaaaaatttcccaacgaagacagtccaggaccagatgtctttactgctgaattctaccaaactttaccaattctcctgtaagtgttccaagaaaaattgaagaggaaggaattccccctatctcattctatgaagccagcattaccctgatgccaaacccagacaattatgcaacaaaaaatacaggacaacatccctgatgaacactgatgtagaaattctctacaaaatgctagcaatccaatagaacataaaaaatgtaatattatcaagtggaatttatcccaatgatacaaggatacatcatacacaaatcaataaatatgacatattacatcaaacagaatgaaaaacagaaaacatgatcctttcaatagacacaaaagaacatttcataaaatttaacatcccttcgagataaaaactccaacaaactaggcatacaaaaaaaattaacaaaataaagaccatatatgacaaatctacaagtagtatcaaactgaatggggaaaagctgaaaaatttctccctataaaactggaatggtcaggcgtggtggctcacgcctgtaatcccagcactttgggaggcagaggtgggtggatcaatagatcaggagatcgagatcatcctggctaacacggtgaaaccccatctctactaaaaatacaaaaaattagccgggcatggtggcagatgcctgtggtcccagctgctcgggaggctgaggcaagagaacggcatgaaccctggaggctgagcttgcaatgagccaagattgggccactgtactccagcctgggcaacagagcaagactccatctcaaaaacaaaaaaccaaaaacaaaaaaaagaacaagacaaggatgcccactttcaccactcattcaacatagtactggaggtcctagccagagcaatcaagagaaagaaatacaaggcgtcctaatagaagaaatcgttgtccaagtactgctctttgttaataacttatagctagaaaaagctaaaccctcaccagaaagctctcagatctgataaataaatttagtaaagttgcaggatacaaaaatcaacatacacaattcagtagcatttctatataccaataatgaactggctgagaaagaaatcaagaaggcaaacctatttacaacggctggaaataatacctaggagtaagtttagcccaggagggaaaggtccgtataaaatacagaacactgacaaaacaaattgaagagtacaccaacaaatggaaagtcatcccatgtttatcggtcagaagaattaatgttattaacatgatctttctactcaaagcattctacattgaataatgcagtccctatcagaatacagaaatggaataaaaagtgatcataaaatttgtacgatcaaagaccagcagagagcctgaatagccaaagcaatcctgagcaaaaagaacaaagacttatgaatcacactacttgacaaaacagcaaggtgttagaataaaaacagacatatagaacaatggaatagattagagaactcagaattaaatccatgtatttacatacaacttgtttttgacaaaagcaccaagaacatgcattagggggaaggacaccttcttcaaatggtgctgagaattggattgtcagatgcagaagtatgaaactggatccctgtctctcaccatattagaaaattcagctcaagatggattaaggatttaaaggtaagacctaaaactgaaactacatgaagcaaacatagggaaaacagacaggaccttggtctaggcaaagattttatggttatgacctcaaaagcgcaggcaacaaaaacataaatagataattgggactgtagaaaatgaaagagcttctgtaaaacaaaggaaggattcaacagagtgaagagacaacctgctgaatgggagaaaagatttgtaaactattcagacaagagactaatatctaggaaatacgaggatcccaaacaatttaacagtaaaaaaataatcacattaaaaatggacaaaggacaataataagtatttctcaaaagaagacaaatgaccaacgggtatatgaaaaaatgctcaacatcactaatcattagggaaatgcaaatcaagtcatgatgagccatcatcttgccccagttagaatggctattattaaaaagacaagaaaacaacagatgttgacgaggtgcaacgaaaagggaactcttaatacattgttgtagttcagaatataagtcagtatagccactattgaaaacagtatggagaagatttctcaaaaaactaaacatagaaatagagtatgtgtcagcaatgccactaataagtatatatgtaaagggaaagcaatcatatacttttctaactatcaggaaaagtatatgcatggcatacctgtacttgcatgcttattgaggcactatttataatagcaacttaagtgtccattagtgaacaaatggataaagaaaatgtggtacatatatacagtggaatactcttcatccataaaaaagaattacattttctgcaccaacatgaatgaaactgcaggttattaagtgagacaatcgaggcaaagataaatagattttacattttcttactcatatataggtgtaaaaaaagttgttctcatggaaatagagagtataataagataccagaggctaggaagggtaggaagggaatataaaaaggggttatttaatgggtacaaatatatagttggaaggtatatattctaatgttcaacagcagaaaggggtgactagagttagcaacaatatgatgtacatttcaaagtagatgagagaactcaaaatgttcacagaacataaaaatgataaatactcaaagtaatgaataccccaaatacactgacttgaccattacacattcagtgcgtttaacaaaatatcacatgtatgtacatatatgtaaaacgttatgcatcaataaaaataaaagttctaaaaagagaataaatctaagaggatagcttattgctttaaaataaaatgacaagacaactataaatcttcaggtttccctctgcaaggaataaatcctattgtatgacaattaaatttccctcttataagatttaaatgacatcaacaaagactttagttcatcattattttacccaaatattgttgtaaaatagtatattttcatcttatatttcatgttccagctgtaaaatgtcacatgcattttatatatagaaattatttaattggaaaacatatgtaccaacctaatatctatttttccagtgcccagctttaaggtttttggatattcatttgcaggttctgtgatgtctttttttgtttgtttttgtgggatggggggacagggcctcagttcttttgcctaggcttgagagtagtggcacaatcatagctcaccgcagccttgaactcctggcctaaagcaattctcctgccttggcctcccaatgtgctgggattacaggtgtcagccatcacacccagccctgtgatatcacttataattatgtataaaacacagttaactccattttgaagacagtgaagtaagttttccaactatcagcaaaatatacattacattcaaatattatcactgacttaaaaccacatagaaaattttaaactacttatgccattttattctcatttaccatcattagaatggtcaaaatgtttttgccaaggcaaaattctgtgacaagaaacacagatatcaactatagaacacttttctgaatcaaacctaatatctcatgtattccttcatagctgaaataaaattaacaaataccaatagatgtttttaatatatttctttagtctcatgaactcattgtgatgatatgactaggaaaaccatccacaaagtgtctattacatattatttagcattagaacctcatggctgcatttctcattattaatttattaatgtcttgtcaatcattcaaaaatcacttaatgtcactgtataggccaaggatattgttatttcacctgtaattaaaaaaaaaaagttgtgaaaataatcctggtaagctaattgaaaagagattctcagttatctaggtaagaattatatttaaatgtttctgaacaaatttggcatagaacctaatccataatgcacatcttcaatcgcatgattatacttcattatttaaattccccaactgagtaagaaactcttacttaactaaagcatactttaacaaatcagcccctaggggagatagaaattataaattgaccattttccataaagttaaaatggtgacaaatcatagaagaatgtgaaagattagtagaaaataccaaaatttgttataaagggtaaattcaagccaggctcccgcacacacaaatatcatatttaatgtttttcaagtctctgttgtctaagtaggtgaatttgggacagttacatgcaattatttgtcatccaaacaactgaaatggataaggagaacaaaaattgctttcatttattagtgactggttccaactgcccagaaaatactcagtttttttatggtatctgaactgagaaagatgtacaacacataacatcaagagaacacactggaatactctcatgcctcttctaacttttaggccactgggaaataacatttacgtcttaatttttgtcatgaagagcaatttcaagatttcccatcagggaagaggaaattgctacaataatatctgaatgttaatataatcatctgtatcatacctatttggtatatattactttgtcatcaaaaaggcaatggccatttttcattcatgtaagtgccagtgaaatattttcttaaatattttcttaaatatattttcaactgcagagtttgactctaaattgtctgaaatatttacagtaaggatttctagttgaaataccgtatatagagaaggaacacctataatattgcaatcgcattagattttctgaaaacaaggtactctataatgagttctagacaaaaatcaatctaaatgatataaaattagtgtttatgttcacaaaaatatttatttatttaaattaactctaatcctcctgagaattaaccctctcaattttaacctgtgtaaacttataaacatttcttgccattatggtatcaaaatgtgatgattacagcagaggcggaaaaaagttaaaacagcccttgttcagccaattgatatcaaacccaacataagaggccttaaaaatattcttctcttttatagcaaattctatgtatctttccatgattatttttgtaggttaaaatcctgcatgcatacaaagccaagtctgaaagcattcactccaggagtaaaactttccaacaggcagagctaattcttggaaaagaaggctataaaaacaactcaagagtgatgcagggattagccaagcagaaaatagaatccgtgtcaccattctcaggaagtcaaaataaaggggattaaaaccaaaccctaacgggtttgtaaatgtcattttgaggatacaaaaatttctctcgagtcctagtgtccttccttttttggtcaaatttgactgtcattattcatttttgttctaaagttaccctggtaaataagtaagaacatttccatatcatatttcatatcctaaatggaaatggctttctacactaatattcaaaagacatctagaacaggcgcaatcttttatccctgattttttgttttattcctttaaagagaacatcctcactttgttattcacaggggaaagctgacaaagcactctcttaatatagggaggattttttttttttttttggactggcaaacaaaccaatctgtttgaaactcagagaaacaatgtatatgaaacccacgaccaacgcatgtagaatgtactgtcttacagagaaatcataacgggaagagaattgtctgattcacaaaaggatatttttaaagagatatacctattatctatgagcataaacatacataatttattaagtttaccctagatgtacttatttttgcatatgttagcatctaaacacactagaaacagctcctgaaatcgcttatgctaatgcctactgctactcattttaaaaggcaattccacttaaaactaaacctcaggcctcaaaacaccagttaaggccaaagcatatcaaattctatatatgaaatcctacaaggtttcaatgacttcctaattttataaagcaattctatcaacaaagcttatgtttaaaattgtcaaagcattatttggcaggtatttcttaaaccaaatatagcttcaatcccccaataataaaattctccccaaatgtttcattattctcctaaggggcataactaatttaaaatgaaatttctttggagagtagccaacatcatgcataagctacagaaccaatatctggttaaataaaaatatgaacatcacaaaagcaattactatacaggcatgaatcacgaattttgctggtaaatctatcgaagagagtgttctaagtctgagacttcaagagatggtgttctgtcttttgtgactaagcagtcagtaaataaaaattcttatgagttattatttttttctttgaatcatcattgagattatctcctgaaaaatgctgagcaaaaatgtataaatgtgtacttggtggtttccctaacacaatggcaagaattgacatattttaaaaatatatgacttatgctgaatcctcatcttatttgcagccataagtaaactttaagaaactttttattattatactttaagttttgggatacatgtgcagaacgtgcaggtttgttacataggtatacacatgccatggtggtttgctgtaccaatccgtcatctatgttaggtatttcccctaatgctatcactcccctagccccacacaccccaaaaggccccagtgtgtgatgctccactgcatccatgtcttctggttgttcaactccgatttatgagtgagaacatgccgagtttgattttctgttcctatgttagtttgctgagaatgatgttttccagcttcatccacatccctgcaaaggacatgaaactcatccttttttgttgctgcatagtattccatggtgtatatgtgccaaattttctttatccagtctatcattgatgggcatttgggttggtttcaagtctttgctattgtgaatagtgctgaaataagcacagaataatttataatcctttgggtatatacccagtgatgggattgcttggtcaaatggtatttctggctctagatccttgagcaatcaccacactgtcttccacaatgtttgaactaatttacactcccaacagtgtaaaatcattcctatttctccatattctctccagcatctgttgtttcctgactttttgatgatcaccattctaactagcatgagatggtatctcattgtggttttgattttcatttctctaatgaccagtgatgatgaacttttttttcacatacttgttggccacataaatgtcttctttgagaagggtctgttcataccctttgcctactttttgatggggttattttcctgtaaatttgtttcttgtagattctggatattagccctttgtcagatagatagattgcaaaaattttctcccatcctataggctgcctgttcactctgatgatagttttcttttgctgtgcaggagctatttagtaagatctcatttgtcaattttggcttttcttgccattgcttttggtgtttcagtcatgaagtctttgcccatgcctatgtcctgaaaggtattgcctaggttttcttctagggtttttatggttttaggtattacatttaagtctttaatccatcttgagttaatttttgtataaggggtaaggaaggggtccagtttcagtcttctgcatatggctagccagttttcccatcatcatttattaaatagggaatgctttccccattgcttgtttttggcaggtttgtcaaagatcagatggttgtagatgtgtggtgttatttctgaggcctctgttctgttccattcgtctatgtatctgttctggtaccagtatcatgctgttttggttactgtagccttgtagtgtagtttcaagtaaggtagcatgatgcctccagctttgttatttttgcttaggatggttttggcaatgcaggctcttttttagttccacatgaaatttaaagtagtttttttctaattctgtgaagaaagtgaattgtagcttaatgaggtaacattgaatctataaattacttcgggcagtatggccattttcatgatattgattcttcctatccataagcatggaatgttttttcatttgtttgcgtcctctcttacttccttgagcagtggtttgtagttctccttgaagaggtccttcacatcccttataagttggattgctaggaattctattctccttgtagcaattgtaaatgggagttcactcatgatttggctgtttattatcggtgtataggaatgcttgttatttttccacatcgattttgtatcctgagactttgttgacactgcctatcagcttaaggagattttcggctgagatgatggggttttctaaatatacaatcatgtcatctgcaaacagagaatttgaataccctttctttctcctgcctgattgtgctggccagaacttccaatactatgttgaataggagtgatgagagagggaatttttgtcttgtgccagtttttaaagggagtgcttccagcttttgcccattcagtatgatattggctgtgggtatgtcataaatagctcttattttgagacacattccatcaatacctagtttattgaaaatttttagcatgaagggtagtgaattttatcaaaggccttttctgcatctattgagataatcatgtggtttttgtcattggttctgtttatgtgatggattacgtttgttggtttctgtatgttaaactaatcttgcatcccagggatgaagccaacttgatcatggtggataacctttttgatgtgctgctggattcggtttgccagtattttattgagcctttcacattgatgttcatcagggatattgacctgaaattttttttattgtgtctctgccaggttttggtatcaggatgatgttggcctcataaaatgagttagggaggagtccttatttttctattgtttggaatagtttcagaaggaatggtactagctcctctttgtacctctggtagaattcggctgtgaatctgtctggtcctgggctttttttggtttgtaggctattaattactgcctcaatttcagaacttgttattgttctattcagggatttgacttcttcctggtttaatcttggaagagtgtatatgtacaggaatttttccatttcttctagattttctagtttatttgcgtggagatgtttatagtattctctgatggtagtttgtatttctgtgggatcagtggtgatatcccctttatcattttttactgtgtctatttgattcttctctcttttcttcttttttagtctggctagccatctattttgttaatcttttcaaaaaaacagctcctgaattgagttttttttttttaagggtttttcgtgtctctatctccttcagttctgctcttagttatttgtcttctgatagcttttgaatttgtttgctcttgctgctctagttcatttaattgtgatgttaggatgtcgattatagatctttcccactttctcctgtgggcatttagtgctataaatttccctcttctaaacacttctttagctgtgtcccacagattctgctacattgtgtgtttgttctcattggtttcaaagaacttatttatttctgccttaatttcattatttacccagtagtcacccaggagcaggtttgttcagcttccatgtagttgtgcacttttgagtttcttaatcccgcattctaattagattgcactgtgatctgagaggctgttatgattttcattcttttgcatttgctgaggagtattttacttccaattatgtcgtcaattttagaataagtgcaatgtggtgctgagaagaatgtatattctgttgatttggggtggagagttctgtagatgtctattaggtctgcttggtccagagctgagctcaagtactgaatatcctttttaattttctgtctcgttgatctgtctaatattgacagtggggtgtgttcaagtctcccactattattgtgtgggagtctaatacccagtggtgcctggaacgccagcgagacagaaccgttcactcccctggaaagggggctgaaaccagggagccaagtggtcaagttcagcagatccaacgcccacggagcccagcaagctgagatccactggcttgtaattctcgctgccagcacagcagtctgaagtggacctgaggctccagcttggtggagggaggggcgtccgccattactgaggcttgagtaggcggttttccctcacagtgtaaacaaagtcgctgggaagttcaaactgggcagagcccactgtagctcagcaaagccactgtagccagactgcctctctagattcttcctctctgggcagggcatctctgaaagaaaggcagcagccccagtcagcggcttacagataaaactcccatctccctgagacagagcacgtgagggaaggggcagctgtgggtgcagcatcagcagactaaacgttcttgcctgccggctctgaagagagcagcagatctcccagcacagcactggagctctgctaagggacagattgccttctcaagtggggccctgacccccgtgcctcctgcctaggagatgcctcccagcaggggtcgacagacacatcatacaggagagctctggctggcaactggtgggtgcccctctgggacgaagcttccagaggatggaacaggcagcaatctttgctgttctgcagtctctgctggtgatacccaggcaaatagggtctagagtggacctccagtaaactccagcaaacctgcagcagaggggcctgtttgaaggaaaactaaaacagaaaggaatagcatcaacaaaaaggacatccactcagaaaccccatctgaaggtcaccaatgtcaaagatcaaaggtagataaatccacaaagatgaggaaaaaccagcacaaaaagggtgaaaattccaaaacccagaacacctcttctcctccaaaggatcacaactcctcaccaaacaagagaacaaaactggatggagaatgagtatgacgaattgacataagtaggcttcagaaggtgggtaataaactcctccaagctaaaggagcatgttctaacccaatggaaggaagctaagaaccttgaaaaaaggttagaggagttgctaactacaataaccagtttaggcaaaacaataaatgacctgatggaactgaaaaacacagcacaacaacttcatgaagcatacacaagtatcaatagctcaatcgatccagcagaagaaaagatatcagagattgaagatcaacttaatgaaataaagtgtgaagacaagattagagaaaaaagaatgaaaaggaatgaacaaagcctccacgaaatatgggactatgtgaaaagacaaaacctaagtttgattagtatacctgggaaaacattcttcaggatattatcccggcgaactttcccaaactagcaagacagcccaccattcaaatttaggaaatacagagaacatccacaaaaatactcctcaaaaagagcaaccccaagacacataattgtcagattcaccaaggttgaaatgaaggaaaaaatgttcaggacagtcaaagagaaaggtcggcttacccacaaagggaagcccatcagactaacagcagatctttctgcagaaaccctacaagccagaagagagtaggggccaatattcaacattcttaaaataatttttaactcagaatttcatagccagtcaaactaagcttcataagcgaaggagaaatagaatgctttaaagacgagcaaatgctgagagattttgtcaccaccaggcctgtcttacaagagctccttcaggaagcactaaatatggcaaggacaaaccagtaccagccactgcagaagcataccaaattgtaaacaccatcgacaccatgaagaaactgcatcaactaacaagcaaaataaccagctagcatcataatgacaggatcaaatttacacataacaatattaaccttaaatgtaaatgggctaaatgccccaattaaaagacacagactggcaaattggatgaagagtcaagaccaaatggtgtgctgtagtcaggagagcaatctcacgtgcaaagacacacataggctcaaaataaaaggatagaggaatatttaccaagcaaatggaaagcaaaaaaaataaaagcaggggttgcaattctattctctgataaaatagactttaaactaacaaagatttaaaaaaaacaaaaaaagacaaagaagggcattacataatggtaaagggatcaatgcaataagaagtcctaactatcctaaatatatatgcacccaatacaggagcacccagattcataaagcaagttcttagagacctacatagagacagactcccaaacaataatagtgggagactttaacaccccactgccaacattagatcaacgagacagaaaattaacaaggatgttcagtacttgaactcagctctggaccaagtggacctcacagacatctacagaactctccaccccaaatcaacagaatatacattcttctcagcaccacatcatacttattctaaaattgatcacataattagaagtaaaacactcctcagcaaatgcaaaagaatgaaaatcataacaaccaacctctcagaccacagtgcaaacaaattagaactcaggattaagaaactcactcaaaaccatacaactacatggaaactaacaatctgcttctgaataactactgggtaaataacagaattctgacagaaataaagaagttctttgaaaccaatgagaacaaagatacaatgtgccagaatctctgggacacagctaaagcagtgttgagagggaaatttacagcactaaatgcccacaggagaaagcgggaaagatctaaaatcaacaccctaacatcacaactgaaagaactagagaagccagagcaagcaaatcaaaagctagcagaagacaagaaataactaagatcagagcagaactgaaggagacggaaacatttaaaaaaaaaaaaaaaaaaaaaaaaaaacatcaacaaatccaggaggtgtttttttttgaagagattaacaaaatagactgctagatagactaataaagaaaaatagagaagaatcaaatagacacaataaaaaatgataaaggggatatcaccactgatcccacagaaatacaaactaccatcagagaatactacaaacacctctacgcaaataaacaggaaacctgtttaagcgataagatgctctttcaattggaagagtctatatatagaaaggctttacagatatgagattttattgggaaaacgagaccataagcagtggctggatcttcattaatcagcctgtatttcatattacattttgttgattttaaattgttgaagtttgagacagtaaaatggtgatcttataggatatacaatgtacctttctacatatacttcccacttaggagagcatatggagttaggtataccaggctcttttagctataaaatacactattcatgtacctgcctttttctgattacaggctcgtcaacctactttttaaaattgtttttattcatttaaattttttgtggatatatacataggtgtatatatttacctattttctgattatgatgtggatgcccatttaggcactcctattctgtaagttcaaaggagcactagaggtcaaaagccattttgtcacttaataagaaaaatatctatttttaaatcttctcttactgttttatgaaaggataggacacacacaagaataactagagcatacaccccaataatgggaactgaccatatgtgattcaataaaaaacaaacatattaacagccttatctttcaaattcatacagtatagctctttatcctcagaggttgaagtccgtattttcattatgtctgccctttctacctcactgaactaagagaaaacatacaaatgtgtactacgagtcaatagtaaagtaatcctcccctatactgcaaactaaggacgtaggattaatagtttctcccttagagctaaaaacaggggtaggagggatactatcgtgtatagaagcaataaaaaggggttacagtattcagtgttcagccatgcattatccaaaggagaagaaacatttcaagtcaacttaatctgatcccaacttcacaaactaacatttttgttgtaatttgctttcccaagtacatgtgcttatcaagagcaatatatttgtcaattgtatgtgaatattctgctgcttgttatatctcatttaagattactgaatttccatttttatttatatatcactttttaaacttaaagttaactcctcccaccccaatgtggatctgctagatgatctgaggcaatcaggcttctgcgtctgcaaaactgagtactagattctggttgataataaattcactggcaaaaggctgtcttctgggtcatttttgagttttcttgatgggacctaccatccatattgaaagatctcctgttttggaattgatgaaatcgatttaatattcccaaaagcatttaattatcagcttctattgtagaacagcttctacccaaatatcatcttcaatcccaccgatttcacttttccaactcctgattttagagtgtagtaaagccttgagaattgagaacagaggctaccatttcaaaattggcatggcaaaaagtgtacttcataggctagaagaagagtagaggtcacagtgttattatctctgtaatctctacgtctggaaggtatgactatgtagcaccagagataagagtcaaagttattgaagtgtaatgtaataaaaatataaatacacttctgcctatcaactaaagaagcagaaaatgagtaaccatccaacagaggatctccccagagtgaaaaattacaacagaagtagtggcaggaatagatttcctgatttaaatagtaaaccatgttgccttttatagagtatatgaatgaaattggcaagagtagctaattaattatagctgattactctatcaaatctcttggtagcataagcaaaacattaactttttataattatttggagtcaatgcactccaaatgcagtatgctccatccatagggcatacacattttaaaggcttttttcctaaaagtcttcactgcaattttagatactggtattttgagaactagaattaaataagacaattcataatatagtgcaagaaggctgaacattttaaatatatctacagtattggaaaacttaagatatgtagttttgtattttgtgtagaaatgacaagtctcagatgaaaacattaaactctaccatactaaaagcagtggtagtccagaaatttaccaaccttcaggatcgagtagtttctctatgcctaattgatatctggcgatgttgaatgcatgttccagtcgttgtgtggctgactgctggcaaaccacactattccagtcaaataggtctggcctaaaacacatacacatacacacatacacaaagacaaatataaatcaatctagaatgttccatgagatttacttccatgcttaattttcattgacaaccaatgcccatagtccttaagtcttgagtgtaattcatttaccctttaaaatatttctatttaaacaagtaataattttaatggaagatctcattgggtgtggtggctcatgcctgtaatctcaacaatttgggagacggaggtgggcagatcctttgagcccagaagttcaagaccagcctagacaatttggtgaaaccttgtttctaccaaaaaaaaaaaaaaaaaaaaaaaaaaagaaagaaagaaagaaagaaagaaaaactagctgggtgtggtgtcacatgcctacagttccaactactcagaaggctgaggtgggaggatcacctgagcccagggaggttgagggttcagtgaaccataatcgtgccactgtactctagcctgggcaacagagtgagaccctgtatcaaaaaagaatgctgaggatgtataccttaaatacatacaacgtttatttgtcaattatacagcaataaagatgtggggaaaaaagaaaatcctgaagatgacaaataatctacgctagcttatccaagcaacaaaaatttatctatctcatccagtctcgtggatttcaataccagccatttactggtaatgcccagttttatatgtctaacccagacctcttccctaaacttcaaattatagattcttctaaacactcattatctccatttagtaatcacaagcttcaagtgtcctgaactgagcttctgatgtttatcctcatcatactcccccaaacctacctacttttcttgctgttctcccttcctcaataatgaacaatgtgtttaaaattgcagttgctcagataaaaacccttggagtcatccttaatgactattttactctcacacaacatttaattcaaaatgtattcagaatttgactgcttctgactatcctcactgccatcactctagtccaaaatccattttatcttgcatgaattatcacaatagcctcataactcttctctcactcttgcctgcgttaattagtgcatagcagagttgccagagtgatctgttaacatgtttcatcatatccgtcttctcaaatctctgctttaggggaagtacaaattacgtatttcatgtgatctacgaagtccaacagggtccaggtccctattaactctctgattttatttcttgtctctttcctcatattccataaacaggatccatagtttcctgcacttggatttggaattcgcttttcgaagacataaacatggctcactcctttacttccattgggtctttactcgaaaatcacatcactgataagttcttccctgcccaagccctatctaaaattgcatgctggccaggcaccttggctcacacctgtaaaccaagcactttgggaggctgaggctgaaggatttgcttgaggccaggagttagagaccaacctgaaccacatagtgagacctggtctctacaacttattaaaaaaaaaaaaaaaaaatagccaagtgtgctggcatgcccctgtggtcccagctactcaggaggctgaggttggagaatcacttgagcctgggtggctatagtgagccatgattgtaccactgcactccagcctgggtgactgaggaagaaccagtctcctaaatagataaatgaaagaaaactgcatgcctcaaatcaaactcacatatacttattttctttctccttatctgctttatactattctcattaacacttactatttaacgtattatataatttaattaaatttctctgtgtatctttctcttccactagaatgtacaatcttttattgcctattttgttcactgctggaaacctagcctgacacaaaataaaggctcaacaaatatttatcaactacacgagagaatggatgagcacatgaaacttacataccatgttacttgataatagagaaaatgcaaaggagtgtaagaggcagttcttgtcttataaggattttaaatttaatgagcaagaaaaatgaagaagccatatgaattaattaaactctaaatgtgaaaaaacacagacaataagaaaatgttttgtaaaatctgaagcggtcaagaaagttttctgaggctgaaagacagattaaatagacgtttcgacttgcattaaaaaaaatgtattgataatagaattctaagttgtgtgagcgttagagaattaaagttcttagggaaggaaaaaagcaaaacatgctcagataatcaagacctcacaggcctggctccattggaagattctaagtatcaagtggtgggagataggtttaaaagaaagaaactggctgagtttgcataaggtgttggctgttaacgtattataatttatcccaacagcactggaagtcattagtcaagtggttcttcacctattctgaatcacagacacctttgagaatctgttgagagctatgaaacttctactcctacaaaaaaactctccatatctgtgaacagagtctacatacagttttagaatatttgaatctattaatggactcctgtttaagagctcatgctatgcaaaaacaaaaaaacaaaataacgaaaaaaacaaaaaaaaagttacaaaggtagtttagctgttatttttctaaaactgtaattcaaaattggccaggcgcagtggctcccgcctatactcccagcactttgggaggccgagacgggtcaatcacctgaggccaggatttcgagaccagcctggacaacatggtaaaaccccgacactactaaaaatacaaaaattagcagggcatggtggctcgtgcctatagtcccagctactcaggaggctgaggcagtagaatcgcttgaacctgggaagtggaggttgcagtgagccaaggttggcccactgcgctctagcctgtgcaacagagcgagactccgtctcaaaaaaatacataaataaaggtataggtttattggtttcttcttaattgcttctactctagttaatacaccagaatttttacaattattaggaaatcgaatccctccatattttccaatacccctaacagctaacaagcttatggaaactagcttatttacaaattggataatgcctttgttatgaaaaatatataaaaaaatttaaaaattgtagaatatttaggggacttttaagttcactatgcgcactctgccttatcttcatttttttctgtaggcaatgggagtaaaaaaaggacataggtgggaacatatgagaaactagttttctcatctatggcatagtatacaaggttaaattgagtatgatgagaaaaaagagcattgcttatgcattcgtgctgtattcccttgtcttaccttccccatttccttggccactaactaaccaactgagtgtgtggatatcttatctaagtcatataatttatttgagctttggcattctcattcaaaaagcattgaaccaaaaggcctttgaggtcacgtctagcattaaaaatgaattgaattcttttatactattaaaattaattaacattttaaatatctatgactttcaaatgcataaaaattgtaaaactaaccaactatgaaggaaacccacacagcatttaatgttaacctggaccataatttattgacttgcaaccaaggatcaccagatttttaattaaatcaacaccatgattaggatagtgtaaatttaaatcctagctctaccacatgttagccaaacagttttaggtaaattacgtaacctctctatgactcaatttatctatttgtgagatgggtaaaatgacagcatctacgtcatggaacttgattgaatattttacctagaacggtgtctacaaaataataattgtttaaaaacattcgtttctattattttgctgtaatgttaattacatttatataagaagagtgatgtattttcaatttacagactcaagccaaaaacacctatctttacagaactgatataaatgttacaaatactactgatgcaaacagaatgtaatccgaaatgggaggtggagaagaggcgagagtaagaatgtgtgatgattttctcgtttttcatattggtcaaaagttcctttctaaacttggtaaaaatttaaaatgaggtatactcataccatttaatgtaataaaagcaaaaattacaactataaaatgattataagtaataaaattaggaaatacctggggatgaaacataatatggctggttttcatactatggagtaaatacctatactgttagaaattagtttgtcaacaagtagaaacattatcacacatattattataaccagcaggaaccaaagtacaagtagctgacagtgactgcatctaagaattgaaataaggtaagttaagattggggtcatgaagacacattgtgtttctgttttccctttgctcctgattctagtgttcatttgcttctaatttgctgtggtaatacactaaaataaggatttaggaagacaattgtaactttatagttattgtaattttatctgcatcttttgtacatatttctaagcaattatcattgggttttaacacaaaaagtagaaatctggcttcctttgaagggtattgtagtggactttgcgttttatcacacaacttttaactgccatgacacttagtcaatccttatgctctatattaactacatgtctttgttctgtatagttgaaccactcaattattgaaatgagggcacctcatgacattcctaattgtgccaacgacaatcgctatggaacagagagttcaaccatttttttctttagataaagaatatgaacatctgccaaatacaaaaagaagggggagatgattcatgaaagaacattaaacaactgtgaagaacctcttgaaaagtaaccatgtaatacataaagagagttactgatgattcatccaatatgacaggagagagtatataaatgaggatattttgacagagaaagagtgggtcagggacagataaaacagggcaatttgggtatgtttactgtattacctacaaatgtattcagaaatcattaaatagaatattaacaaatatagagtgggaacatgcttgcaggattgaagtcttccacttgaagggaaaaacgttagagagccaacaaggaccacataacctgatccttgatatttttattcatctgcaaatgtgtacatgaacagcaaaatcaatattttcgggcccttagtgttaagcatgtggctgcataaatgagcattgacttaaaacacagacagaatgtctctatcccttctcatctaactgtattgaggctgtggaaacattttcttctgtcatacgagaaacaatgtgttaacgctgcttaacgtgacatttgaatgcatgtctgcctctgttctaaatcaggttgctgagtaattcacctggaaacccagtcgggatggggttaattaaatccagctggagcaagacacctgacaaagatgcttatttgaaatgtgtttgctcttggactgagctttaccttagagaaaattaatattcttagcttttctagaagcaggattggcataggaaaatggtagagtggtcaaaaaaaaaaaaaaatcaaagtgagaaaacataacttgcactgaaaattaggcaagatgcagtccagtgacattttaaacagttaattaggcaatgcatttagccctgggttgggtaaatgaaacgggtaacaggaagaccaaaataaagtgactgtagtccctctctctcaaatacacacacacaagcatatatatatatatatatatatatatacacacacacacacacatatatatacatatatagagtataaatggtgtagtatatatggcatatagtatatattgtatctctaagtgtatgtgtacatatacatatgtatttcctacactgctttgctttttcttgaactgttattaattcatttactgaactttacacaagaaaagcaaaaaaaatctttttcatcttaagaaatataatgttgaatggaatatagttaaggactttggttcactgtattacagtgaattctttttattaaaatccacaaaagatctctctcttgctttatagcaattgatttgctgttccagtgcaattgtttctgttggtattcaaaacattgtgtcatataattaattgtgttctgctctttgtcttggttactaaaaatgctctgagcatcttatgaccctgaactagaacaaagtatacagggctttatggtgtttgatatcaaagtgtgtatctgataagacagatgtttctttctccacactacgtatctgatgatggtaattaatttaactacaactactcacatgagatctagtatcatttttacctgtatagtttaggcttatacaaacacattatctgtataaaaagaccaacaccattctcggcaaagttagaatacaacctggatttactgggattcccagtgtcaaacatattgatactctccccctccactataaccactttcacgctccgctaatgttaatgtttcaacaactgaattatatgtatcccatagaacactggaaaatattcttaattagttcattccaatggaacgttagatcaatgtggtcaatgtacataacatgttgtaaagtaggacatgatctggaaccatactggggaaaaatatgtcatcagagtctaaatcaccacttttacaagttatttaatgtctcagtaatcttcttacctatgactatggatgagagcattcaaagccaggccatcagaccagctggtggtgaagttgattacattaacctgtggataattacgagttgattgtcggacccagctcaggagaatcttttcactgttggtttgttgcaatccagccatgatatttttcattacatttttgacctacatgtggaaataaattttcataagaaaatgcattccttgagcaagaaccatgcaaacttaaatatgaatgtccttgatcttcagtgataaatagaaattttagggccaattagtaatgagacataatagattctaccagaagttaagtctattctcaaaggctaggagtctattctgattcattggtatctatgccataccatttactgaatgtgttcactattactcctggattctgccatattagacccaacatttactgtttatagaattgctcaccttctagctttcaatgaacaagctagagaagacagtgtataaaacattagacttattgttaaccaaggacttaagatataaaagcgctttttggataggaggaatactatagataattgttttttaaagtatatgttcaaattttgcctttgctattaattgtggtaattggacaagttgcttaacctcttctaggcctcatttctgtgtatcttacatgcaaggttagtgtaagatcaaagtacaaaatatggtcagataaaacccctgatttcataccatcatttaacgcaagctatatttattggctgaactgaaaagaagacagaaatgtttgcctacctaaaataaagaaaaaaaacaacaaaggaaggaaatatttatccctaagaggtgtacatatgtagccttggttctattttcattacttggtttccatgtatttgattgtctcataggcttcgtgcatgtgcagatgttattcaacagattatcaagtttaattcttctgagtcatctgatgcagaaatccattctaagcattttttctaagtttcatgaatgcagtgacgcttcatagaaaaaactgtctacatcttttattaaagaattattatttattaaagactgctttttaaatataagccccttatgagatgctggaagaagacatctatgtaaaagtgatcagtctgtaccactaagcactttccttctgggaaggttaaggttcatatactatcaacatttgatcagatgatgaatatttattgtgcattctaaatatgacaattttattttttcatccatatagaagttaacaaatgcctttggggtaaatgcatattttaacatctccaatgttagtcatctttttattaaaaagtaaatgcaaattttaggatatactactaaatctcattttaacatacttttaaaagatttgagatgatgctttgtaaacacagtaacgattcggagatatgaaatctttgcatgtatctgtcacaatcccttgataactaagcctattatttaggagtggattatccaagttttcctaattccttcttgacctacttatttagtcagttactcagtgaatacaggtcaaataattacgtaatttgtctcatattctaaaattataaattgctcaacctttatgtacagtgactgcaggaggtgtattttgtgtcctgtgctaaattacggttggaatcagcagatagtggcttaatggtggtaatggatttgcaataatcaagcaatcctccaatgatgaatgtgattcatttgtgaaatgcttggccagtctgccctctatgtgcataacgttaaaggacaacaaagtattcaatccaaaactcctttatagcatcattatgtcactaattcagcttatcagcctcagcctcgctgttattgcttctacttaggtgcaaatgttgctcagacaaaaaaaaataataaagggcaatgtatgataatcatgtctccttttcctacataaaaggcagttatcaaaaaatcattgagctggtccccaaaggtgagcctgtaaacagaaaactgtcccgtcctcaggtctcactgtctctaaaggaggctcaatttaaacagatgtatttgtgtgtgtgcgcgcatacaactataaatcaatttttaaaaggaaaaaagttgaaatgtctttgagcagtgatttttaaaaatgactaggagttaactgggccaagaaggcatgatggacatggaggtgcaccaccaagattgaccttcaaggaagggcttgttgctccagctgtggtcaggcagcttctagttgttagttctctcaggtaccacctgagttgcagagtcctgccagccaatgtcacaccctctctagggcaacccactactattgactgatgaaggggcagagtataaacactcagccattttaaccccatttgagacaactctgaggggtcatcctagctgcaagttgtctatggggtttgaataagcgtgtcatagggtctacgtcacagctctagttcttcctctttccactcctgtcacctctgcccttctacaggtgtttttttttttttttttttttccagggcatggcttaataaacatgctgcctgccaaactcaactccgaagtctactccccagaacccagactgtgattaaaagaagttgcagcagaggaatagaaatgaagagggtaggaataatcttatatggtaaggatagtttctgtgaagctctgcagaagagcagagcaagaactgtcttgcacagaagtgacttggtaggcaggaatttacagggatggctttcagcagtgcgaacgtcatcattctcctgtaattgcaaattgtatcaataatatgaacattctaaagtgaattagcgttgccattaagtacatcccttgaattgtccagtaaaagtatggacctgacttctgatagctcaccactgttagcaagatttgttattacaaccagctggttgccagagccaagtttagcactccgaaaaaaaaagaattgcacttaagaaggaagaaaaagatgccaaacacatgttatatgctttgcaattttgttcaaacctgcctatgttacaaaatatgcgttactgttttaggctagcaattttatttgagatggacagtagaaaaacagtaataggaaaacagagtttgcattcctgagttttcacaagttcaatgagaagtcctccatggcactattaataacatagtatgttgcattagaaaaaggggccaacatggttctatctgtaaatgccgctcgttatctgatagatctagaatgtacattaagttgaccaaaatgtcctttaatctttgctgaaattcaagggcttctaccatttaataggaagaaaatatgtaatgttggtgtaaaaaaaaaaaaaaaaaagaaaaacacatttttagattcactggattatgatgaacactgagcaagataatttttcaaagtgtgcttaatagttttagaacagggcagtgtgatataagagagatgagataagtaagcagaggctgggaagagtctacagtcttgcagtctcaaggatatggtgattcaagggcataaatgaaaaacaacaggctataagagaggtctcagacaaagaaagatttaaaaagcattccttctgatattcctcattgcaaaagcgcctccacatgctaataatgaaaaatgggctgggtgcggtggctcacgcctgtaatccaaacactttgggaggccgagacgggcggatcacaaggtcaggagatcgagaccatcctggctaacacggtgaaaccccatctctactgaacaaaatacaaaaaattagccgggcgtggtggcgggcgcctgtagtcccagctacttgggaggctgaggcaagagaatggcatgaacccaggaggcggagcttgcagtgagcagagatcgcgccactgcactccagcctgggtgacagagcgagactctgtctcaaaaataaaaaataaaaaaataataataaatgaacaacttgcaagcaagtgaagaaattatcagacataatagtcttgaaagcttatcttggactagttcagatggagttggaaagggcttcaggatatttttaaaaatggtaagatcatataagaagtagtataaacaataaatacagttcagagtgccttttggagctctgtgcatgcttgagttcttctgctggctttgtcaaaacttacatctgtcttacgcaaagcgggatctgcaaactggattcactctaggaattatttgttactatgccataagataaagtcaacaattcagagtgcatcaagaaacttatgtagcgattttacagagtaccatttatgtctaatgtatttaataataaaggaggaagcatgggtgttgggcatcttatttttgtaacgctttggttttattctatcttacatacaatggattaggggaaaagtgttccttcctcaagatattttgagaagtactgagcaacatatgaaaagcagtttggggagagatgcggtatgttgcttgctggttctatttgacaccatcactatatggaacgggctgaaaatcggccaacttgggctcacttaaggctcctatgagctattctttgttgccagcacatattaattcccgctctttctcttcccctctccccgcttactgttgtgaagtagcattaagcctgttcagagaatttggaataaaaatatatgggggccaattaggagagcaacatggctgctgaatttaataggtactctttgtgtctactcactatttgactctgagcaagagcaatctacaattcaagttaaaattcaagccgggcgcagtggctcatgcctgcaatcccagcactttgggaggccgaggcaggaggatcacgaggtcaggagatcgagaccatcctggctaacacggtgaaaccccgtctctactaaaaatacaaaaaaaaattagccgggcgtggtgggggggcgcctgtagtcccagctactcgggaggctgaggcaggagaatggcgtgaatccgggaggcggagcttgcagtgagccgagatcgcgccactgcactccagcctgggcgacagagcaagactctgtctcaaaataaaaataaaaaaaaataaaaataaaaaataaaaaaattcaagtttaccgaatgaagccatgatatctgctacaatagggctggatctgaactattaccctcattgcaagaagccagacacaaaagaacatgtattatattgatataaaatatccaaaaaggcaaatacatatggacagaaatagattgacaattgcctagggctggggtgggagtgaaaaatgactgtaaatggagaagaaacttctttttaaggtggtggaaaagtgccaaaattagatcgctatgatggctatataactctgtaaatatcctgcaaattttaatgaacgtggtgggggggagttattcatccctcaaaatagtttgagaggctaccaagaaccagaactaaaccagattgatgcaaattgaattttacacttagaatgagtacattgatggtctaacaattacatttcaaaaacgctgatttataaaaaagtaatcccgaccagtaaaaacagcagtcatttctcagcctccaaattttttaaatgagtggaaaactttaagcaatcaatacaagtcatatgatacacctcaaataaaagtggtatactacactgagtgccttgcagatattctcccacttaatcgtgataagaaatacatacacatttatttttatttttactcttttgatagtgaagggaccatggcccagaacaggggtggcaatataccaaatgccactaagatggtaaccgtggaagtttaaattcaagttcatgttggtatatatatatacacatacatatttatacatatgtgtataacgagttactattacgtatatatatacaatgagtggaaaatattagtggatataagttcatgtatgattatgtatacatattatgattatactattatgtatatgtatacaatgagtggataatattagtggatataagttcatgttggtcttatatatacatatataatgtgtggatatgagtgtgtatatatatacatatataatgtgtggatatgagtgtgtgtatatacacacatgcatattgtatatatgtgtgtatatatagacacattatatatatacgcatatatactacacacacacacacacgggtgtgtgtctgtatcttttccacaaatccttcaacccattttgcagaggtcaaatagacagtcggaagaccctatgctcaggtgacttaaaaataatttccaaatcacattatggagtttgtatgtattacacacatttattgatagagatacccatattctactaatcttttattggcaataatttatgttaagaatacccaagactgagaaagcctcattcctttggtagtgattaaaataaaacatactaaattaacttatagacaagttatagaacatacatttgtgaaaaaaattactcacctatgattgggactttgtatttttaccttatacttactcaatgaaataaaattttgaaaaatattcctgtaaatgtaccagaacctattttataccgtgatgatccttaacatttcagacgacatggtagtgtcaatttaaaaagcagcactatggagcagggtttgttattgttagaaatacacatttgtttcacacgtcaagggtaaaaattaaaaaacaagattaatgttacccaaaaggaaaccattcatcaggattcttacctgccagtggaggattatattccaaatcaaaccaagagtcagtttatgatttccatctacgatgtcagtacttccaatattcactaaatcaacctgttaaagaaaggggtaaaacatttgaaggtaagagaccaaatgcctagttgcaataataataataataaaaacgtgaaggtaattgcatttagctattttcagagacttagcattgaagctttttgaaaataatctaaaaattaaacaaaatgcatgtgtaaaatcactttccataacaaacaagcaccccaaatatatttactttcagcacatgaatagattactgcagattaaagaggtcaactggagtatctccaaataaaatgtcataaagtatgtttaaaattaagatatgctttctagtatggaattacaactcagaaaaattcaccagtacttccacctagctccaaggagtgccattataattaaggctgactgcattttagtaaaacgcctctgttttagaatgaatgttaggtctctaataaacaatggagcaaactgccagctctcttatctctgtctaggactgtgtttggaaatgaaaatctggcagggttttatttgccttaatcaaggcaaatctctgtgtctcctgtccttcacactcctcaaatgtttaaggtggagtaaagttaaacacaagcatctgaaaagcaagcatatgaaaagatgttcaatgtttttagccaatagaggaatgcaaattgtaaccacaataatgtatcactgcacatttatcataatggttaaaattaaaaaatagtgccataaaatgctggtgagggtgtggagaaactggatgactcaacccctgctagtggaaactcaaatgatatagccactttggaaaacagtctggcagtttctcacaaaactgaacatgtacttattatacaatctggtaattgggctcttgagcatttatctcaaggaaatgaaaacacatgtgtacacaaaaacctgcacctaagtgttcatactacgtttatttgtaatagccccaaactgggaacccagatgccctcaggggtagataaacaaaccatagtacagccacaccatggaataacactcatcaatgaaaagaacaaactattgatacatgcagcaaattggatgaatttcatgggcattatgctaagtggggaaaaagtcattctgaaagggtagcatactgtatgaatccgtatctatgagagtcttgaaaagacaaagttacagaaatagagaacagaatagcagttggcagaggtcaggaatgggagtaagatgtggggtagctgaatgttcttataaaagggcaatatgagggacccttgtaatggtggaactgttctgcatattgactctgatggtggatttacaaacctacacacgtaataatgttgcatagaactaaatacacacatatgcatgcacacatacacataaatatgagtaaagctgggaaaatctgaatactattggtggttttatgaatgttgacatcttggtcatgatatcgtattttagttttataagatgttactacatcgaaggggagattgatcattcaagaataagaaagcatcatcatctgcatcatcatctggggattcctcatatggcagtagaggagagaaattcctccataaggaaaagccactatgaatttatctattgattcattgattcactaactcaacaagtaccttttggctatctgccaggcaatgaagtaataagagcatgtaaaagtaaaaaccttctgctttcatgaaacttaattctagtgatagtgacaatcagatgatatagcactaaagactcaagcagttaagcagagaatatgctatttttaggaaacatactcactcatactgcgggaagcactgctggtagatacgttttgggttgccatggacctgactctggggagacttagatcaagtaataggaacttagattccagtaaccccttatccactgtcataagacttgtcactgtgtaagcaggaagatagttcctccatttccttgtcctcataaaaggtctcataaggtccaatttccactatattcaggtactgggctcagacctgataaaggaaagtaaggtactacccccccagtgtcaaaaagttcacaacagaaggtcacataataaaaaagtatctaccattaggctctagcaattctacctctatgtttataaccaaaataattaaaaacagagattaagatattggtagaccaattatcatagtaacattattcacaatagccaaaatgtgagaacacccaaatgtccatctacagataaatggataaacaaaatgtggtatgtacatacaacggaatattttcagccttaaaaaggaatgaaattctgatacaaactacaacataaatgaaccttggaaacatatgctaagtgaaataagcaagacataaaatgacaaatattgtatgattctacttatatgaggtacctaaaatagccaaattcatagagaaaaaatggaagttattaaaggctaggggaggtgaaaatggagagtaatcgtttaatcagtatgaattcaacttgggatgatgaaatcattctagagatggatagcggtgatgactacccaacaacagaaatatacttaaagccactgaattatacactaaaaaaatagaaaaaatgatacctcaaaccctatctagggcaatgaacctgaatagacatttctcaaaagaagacaaaccaacggccagcacataaatgaaataatgttgaacatcactaatcatcagagaaatgcaaattaaaactacaatgaaatattacatcacacagaatggctattatcaaaaagacaaaaggtaagttgtggcaaagatgtggagaaaaaggaatctttgcacagtgttggtggaaatgtaaattattgtagtcatgaaaaacagtatggaggtttctcaaaaaattacaaataaaactaccatataattcaggaattctactgctgggtatatattccaaaggaaacaaatcaatatgtcaaagaaataactgcacttcaatgtatattgtagtgctactcaaaatagcgaagataggaaatcaacttaagtgtccatcagtagatgaaagaataaagaaaatgcaggtatacagacctacacacacacacactggaatactactcggacttaaaaagcagagaatcctctcatttgcaatgaaattaatgaatctagagtacgttacgtcaaatgacataagccaggcacagaaagacaaacattacatcatgtcacttgtatatgaaattttaaaatgttgagctcatagaattgagagtaaaatgttggttagcaggggatagagcttggaggaggagggttaggcagatgttggtcaaatgatactaaattacatttaataggaataaattcaagagatctactgtacaacatgctgactttggttaataacaatattgtattttgaaaattgctaagagaatagattttaagtgtcctcaaccccaaatgataaacatataagttaatgtatatgtttattagcttgaagcattccacaacatctagatattttaaaaaatcatatgctacatggtatatacaattttttttgctaattaaaaaataaaaaatagttatatggtaaattttacatcatttgtattttaccacaataaaaaataagtcattggaacacacatcgcaccccccccccacacacacacacacacagcagcagccacagataatacctaaataaatgttcatggtttttttccaataaaatttatctatatccacaggaaaaacaattaggtaggcaactgtgtctcacggaagcccaaggggtaagaaaaaggaagtaacattgtgaaaagataagcaaaagacataagatatattcatgtactcagtattgattaaatctgtaaagaaaaaatagattggaatgaagaaaagtatcaggtggagaaagcatgccagaaagcattcagatcactagggggtaattaactgattgggaattggagatattatattcagggacagaattgtattcagtggcagacagctactcttttttaacttttatattaggttcaggagtacatgtgcaggtttgttacataggtaaattgcgtgtcatgggggtttaatgtacacattatttcatcgcccaggtaataagtatggtgcctgataggtagtttttctgatcctctccctcctcccaccttttactcttgagtaggctccagtgtctgttgttccccactttatatccatgtgttcttgttattaactcccctttttttttttttttttgaggtggagtttcgctcttgttgcccagactggagtgcagtggcacgatctcggctcaccacaacctccgcctcccgagtttcaagcgattctcctgcctcagcctcccaagtagctgggattacaggcatgcgccaccacgcctggctaattttgtatttttagtagagacggggtttctccatgttggtcaggctggtctcgaactcccgacctcaggtgatcccgctcgcctcggcctcccaaagtactaggttacaggtataagccactgcgcccagcctaactcccacttataagtgagaacatgtgatatttggttttctgttcatgcactagtttgctaaggataacggctccagctgcatccatgttgctacaatcttatttttgtctgggttgtattccatggtgtatatgtagcatattttcttaatcagtctactgttgatggacatttatgttgattccccatctttgctactgtgaatagtgctgcaataaacatatatgtgcatgtgtctttatcgtagaacaatttatattcctttgggtatataccaaataatgaggttgctgggttgaatggtatttctgttttaacttctttgaggaatcaccacactgctttccacaatggcagaattgattaacattcccaccagcagtcaccacacctggccaatatcttatgcatacattttcagatactgatgcttctactgttattataacaattcacaggatgtatatactggatcagagtgtgtgtatacacacacacacacacacacactctgctctagtagatacatctatacatatatatatacgcatcatttcagggagatatagacatatctatacaagtatatgtgtatctacacatatacacatatatatctatacatctatacacatatatacatatgtatacatctatacacatatatacatatgtatacatctatatacatatatacatacacacacatatatacacatatatatgtaattttagtaggtgtttccacctgccttcctagaaacaatttagaattacatattttaaccagaatgtataagaataggctcttctctcaccaggaaatttttgttttgtttttgattcttttagttttgtttgtatgatcaaatacatcactttgttaacttttatttccatgattccttgtgcatttgaatatatttttgtatcactgacctattacaattccatgtgtgaattgtctgttaatatgttttgctcattaatttctatatggtagttttcttttccttcttgaattttaagagctcttggtaaataagagataacatttgtagaatgcttaccacttgcaaaatgtgattatatttcttataattcaacaaaattttgtatttcattcaaaagtaaaactgtcttacagatttatgatctttgctttttgactgttaagtacaaaggttaacctgacatcacaaaaggaattgtggagtttttttcttttcatatgctttggaatagcttaaagtatataaattattctttaagggttacgttaaattcatttgtaaagaatcctactacactcttcaacagtacacctttaataacctactaaatgttttctgaagtaatcagtctaattttccacttattcttatctcaattttagtgatttgtattgtacgagaaaatcaagttttccagaattttgcaaaattgttataaaattgcttttagtttccacttcatttcttctgtatctgctgtcatgcgtcttttctcatttatctcgtctagtttttattctaagttttctttgttatgactgggataggtttacctattttgttaatcttttcaagagctcacttttgaatggattattcttattcaattttctacgttgaatacaatttttatttttgtttctatttttacaatttcttaagatgcatacttcttttatttccatcttttaaaaatcttatggctatacagttctctctgaatacagatttcactatgcctacatcattagagtatgtatgagctatataaattttaccaagagttcatgaacattttacatttatgtgcattttaccaagagggaaacagagtatcaaagataaatgaagcttccacaaggtctgatttaaaactatgtctggatagaagatatttcattaattacatctagtgaattctccacaaaaagctttaagaggctctctctccaagttaataaacatttcacaccatgatacagacaaggattattatttattttggttgtgttttgtctcttgtacatgtcttcttcaaactaccaaggagtgtaagaaatgctaattgataaccatgaagactctagaggagggaggtatttgtcatgcctgaaagggtattgttcatggcatttatattactcttcaatgcctcacattgacggtctggtctgttttggccatgaattctcataagcttgttgctcttataatgctgtatttcttactattagctgtaagtcataacatttttctgaattcagtactatttcctcttaaataatcatcaccctgccatacagtaacttctcttttatgtttttttttctaatacacattccagaattatgtctttcaagaattatcagtctaattgctaaataactgaatggtaaaaatattaaaaccttttaaaatctgtgtgaagtgaatgattacatctgtctactaagcaaaacagaaaacattaatatgacatgtatgttaatgtacgagcctactgtgtgtatcagtgttgtgacaagcactctatggttggaaattaaatagtagggtcactgtggttacccaaagttctgctttcctgttttgcacaatgaaaacatctgataccaaaataggtgtgaaaattgatattctgtgtgaaaatgtaataacatgccttgagtttttgcagaaataagttaaactacgcagcacaattggcttttgtagttcctgtcaacaggcctaagattttactcataaagtaacatgggatgctgtctcagagttttacactgttatcttcggaagttgctttattcaaatgtaattttggaggatagaaaacctccatggtttgctttgacataatggaaacttattgtgactccagtagaatattaaaatgtgaactctttagaaacacctcaagttacaataagcagtctgtaagaattgcacatagaaaacctaatacattaaattattctttagtatggagtagtctcctgctgtctattttaaaggcataggacaagaacttaagggggtccctcttctatcgccagactagtacttacaatacataattttgtataacaatatatatttagtaattctaagattaatatataatcatttcagggagcatttacttccaggtactctacctcctaaatgactgggctatgaggaacaattctcgtcatttgcttgttcgagacaggcaaaaaacctcgctgttttcttttatcccactttccttcaggaacatggatgtaatttctaccatcgtcaatattttattcaagctaagattagatatcccatgatggtttacagtaaaaggatttatacttattatattgatatattcaagatttaagaatacttaagaaaaacttaagatgaaagtaaacctgaaatatgatggttttctgaaagattattgacaggaacaagttagtgttatttttgatttgctttacagaaagaagaatagcagactagggttcatcaaacagaaaatagtaaataagacgtcagaatgaggggcatgtaacttgaaaataatttcaataaccaagtcaaataatgaaaatggaagttcttagggcagagcagaaggagagagagaagggaaaatgatgaataaaactaagagttacattcctgtaagatatttacgtgtgtgtgtgtgtgtgtgtgtgtgtgtgtgtgtgtgtgtgtgtgtgtgatgtgtggtttgtgtatgagagagagaaaaagacaggtgacaaagttctgacaaagctttaatgaattttttcatacaattttatttttgttagatgcagagagagatggatgtttagagttttgtgtatcatttaagcatttgcggttttaacttggaagttgcagaaagttatatctcattcacaggggaaccatcatctttataatatatggtgtctgcctcttcttgcctttttagacaaccagtgacaaggacatttcagagctacaggctctaatgaaaacacgtcctgcgtcattcagccaattgaaattagactaaagcaggtcgtttctcacatttgtttcaaaggaattggttctcccagatcatttcagagtttgatatttgtcctaagaaggagtcacttttgttccctcatatgcagtgtaaaatacaagcatttttaaaattagctaagggagggggataagggtaagctaccttttcactcagtcttggtgattttaactagatatgaaatggtacaaactattataaaataatttcacaaaaagattctgaaaggaaccctgaaatatccttaaaagtttgagttgatttccttaaacagaatcttaaacaataactaaaagggaaatcccatgcattgaaaattattatgtaaatatccttcctgacactgaaacctcaagcatgtacttccaccatctatttggttctttcatttcttttcatttcatttcgttctcataaaatatatataaaccgagaagttccttccaacattctagataaacagaatttgctttttaaacatgttaaatgtcttttataagatgtctgccatcatgtagccaagctaaagacttctccatattcaagagaaacttctcaagtattcatacaatccttctaaatataatgcattttaaaaagataaaaaatacaggaaaggcaaagtagtttcattgccctgcagcatgtgcttttacaccacatttaagatttacactgtttaaaatttcaagacttatgggcataaatcatacctattttcttccattgagagatgcatgtattgaatctttttcttattaaatcataaatacgtcgatatatacaacctaaacggtgggccatattgccactgtggacctggatttccaatgacagctttttattcccttccttatctccgtatttcaagaattatttttgattcagatatagaaatttacattagataatttttgaagcacattttgacctcaactatattacaagatttaattctgggtactcactacaaagatactatctctaccttcaatgattaagttttacatatttagtcattctttaactatttttgaccactcactatatgccacgcatagaatgttaagaataaatttaaaaaatagactttcaacaaattgcttatggacaagtgaaatgttaaatttcctctatatttcagatatgtttatgatcactctgatacattgcaggagaattatttttaatggagtcatgttttcatttgtttatatactgcctctttgacaataaagaattgaggcagttaatacaagtgtctcataatcctaagaaaatatgaacatttaatggcatgaaagacattaaaacaaatttatcaaaatagaagttttgatacaggtaatctggttgaacgtattaataaaatgcaaactaaactttttgggaaagtagctcttttaactaaactcaacaaaattccttatatagaatatatattagagggcattgcctgagtaaatggacactgtcctcaatactttcacaatttagtatgaaagatatatatactttcagtatattatttaatttgaatttttgtaattacgtatcttttatctggcaatataggatgtaactttaacgacaaaaatcaacccatatagccccaactttttaagctcaagtcacgtatactaatttcaagtaaaaaaaaaaaaaaaaaagcaatagctacaataaaaatcttaaaagatacttgagtgacattataagaaatatttttaaacagtactatttatagttatataattattatcccagcagacctccatatgtgaacataataggtaactggctatctcaatttgaagttgaatatacaagaaatgtgtcaatactaatttcccttaaagcaagaggtatactaagggggatgggaagaataaacaactcacccagaaaattattttaaatgagaacatgctgcaatttaagagtagttatattaccttgcaactgaatgtgagtttaatgaatacgagattatgtttgtatatttgtatcttccataacaagtattttgaaagaagtgaacatttactattaatgcatttcgcagatgataaagtgagtcaaagtcacggaatcatttggcaaagaccctatagttgataagttacagagttaacaagatctacctcttctgcaaacttgagaattaatacatataaagtgcaaatattttacaggcctattgtgtggactgacaattttgtgtaagaaatacttgtctaacaaattaaatttggaatttgtacttaaatactagattttatgagtaataaatagaagtagtttatagtcaaatatattctgacatgctccaaaatatgtattatatggctatttaagtttctgaatacttaaaggacacataaaatactagttttaaagaacattttagaatcctctttatctaacattatatgccagcatgtgaacagtatatcatttttcagatcagtgacatctgacaaccattcaatctaattcagtgactattttcaatgatggggttaagtgaatatttgaacatagctgtcatctgaatttccaccctaggctttttaaatactcaccttggatttgtgatttaatgtatagcaatgactatttgctttgtagtatcccacattgtagatttgaagttacttggtaaaaacttaccaccttgtgatagacaattgatgagctggtacaatgaacataattattagatctacaactgtgtcagttaatattaaattatattaagtcagcgaagtcttggtaatgttcctagggtatatttcaacactataccttttgtatgaatctttataaaagggatcggaattcataaaatgtaagcaaggaaatcataagagggaagacgaggacacaagcttggagaaaggaagacagatcataatacatcttggggagcggggggtagtttaaagcaccacagttaaatctctatcaaatttgtaatttctaagttcctttaccagacaaaaaattaatcattaaactagacacaaaattattaaaagtgcaaatatctaatagagaatactcactgattagaacttagttatatccaaggaaagtttaaattacccattaaatatctttgagagaatagagttaagtgtagaactgaatttaaaatgcctaatgaaaggcactacttacaaacaaaagtgggacagggcaaagaaataatagaatggctgtataagagatgtttcatcctagctgggatttgctttaccttcaaaaacttgtaaataaaaagaagctgtggatacatttttacctagagctgatgtagagacaagaataaccacttagtagcatagtctcccatttctcaggattttgtattttgttcgctttttaaaatcacaaccaactattacaaatgagctttgctctcagcaaataccgcaataaagttatcactgcacttagaagtactttcttctcaataagtggctttccaaaatacattattgacagcagggataacttcatgctaaaacagccaccacaaagaatgcaaattggaacacagacgtagtgtctgagctctacagatataagctgagtggcattcaagtgaggataacaggttaaacgccaggacagggaaaggaaagaaactgaggaacagggttaaactgaggagctagtttagaactacagaatatgctagaactagtgatttatggcagagggacaggctaaaatggaggagaccctaaggaaaagagagaagacaaaatgaccttgacttaatgatccagaaattaccaaaaagtatcattttgaaaagacacttctaatattcctttaaaaatcagagggctaaattttgagtgatttttttaaaccagggtttcttttcataggtttatagaattaggaggctgttcatatgattttctattagcaattatcaatttcttggtgtgtggacaaacttatcactggtattcaaaaaaaaatttttttttttggagacaagtcttgctcgatcccccagactagagtgcagtggtatgatcacctctcagtgcaacctccgcctcatgggttcaagtgattctcatgcctcagcctccccagtagctggaattacaggcgccagccaccacacccgtctaatttttttttttttagtagagacggggttttgccatgttggccaggatggtctcgaactcctgacctcaggtgatctgcccgccccagcctcccaaagtgctgggattacaggtgtgagccaccacgctcggcctcaacttcattttttataataaacatatatgtatttctgtgtaaaacccgtttttggtttctatatctcatacttaatatttcccttccatttttaaactgcatacatttgtttttctccctccttgtctggatcacattcataagatattaatctatttcatattataaggaactagctgtatattttatctagtgtttcttctatttctttatctttagttcctgctttccttaaagcatttttgtaacatttttatttgaaagcttgattcaatttatctttttaatgaagatcaaaatcaaagacaaaaattcaaactctcagtacagcctgagccatttctcatgggttttcatatggaatgctttttccttcacaaatgtagttttatactcttggtttaacaaaccttaatcaaacttaatttataagtatattattagtttctactgttattaaataacatgaattttgaaagtttgtgtgtatttaatgacattttcactgcattcaaatatattgcccgtttataatttgtgtatgtggcaggaaattttttttactattttcctaagcctttaacaagtttacgacgaagagcagatatccgaagtgactctcagcgtgtctttcttttctggctctggttgtctccagaagaataggaaggagtccttagtccccaaattagccagaaaccacgtctactctctgtcatcaaatagaagtggtatggcctcaaaggtgactggcttcctgatgcatccaacaagactgggccctagccaacatcagagttctcggcatgcagattctcaagtcctcatttcgcacagaaacaaaacagaactagatacctggaatgccgattataccgttttccactcctacttcactaacccaccaaacttcttcacctcttctttgtatgtgatgactacatcacctggaatctcttaaccttggacttctggttagactaaactaaggagcggcactggcaaaacactggaggattctatggagagactaaggtatcacttctctcaacttcaccaggcaatgatttgaaactaacagcattctttagatacctaggggctcagttcacagttgtgtccagtggcgctctcccaacatgagggattttatcaaattaatagccctctccccttgactgcttaggtttagatgtagtaaaggttattaactcatgtgaatccctgcattcttcaccatagtttcttcctttaatcctccccacgtttctataaatattcccctgattacactctcttcaactttttctgtatgccacgtgtttaatatcaggacagttaatacacttgacttcacaagataccttaaaattgtatagtgaatgtatcacttggttgcctcaatgaactgaaaatgaaaatgcttttgccctatgaaagacaccatgtggatctactgagctctggccattccataggctcaggggagagcattcccaataatgacagacatacgattttctgaatgccttgttgagagttcagacttgaatttagttaatgtaactgaaatttttaaactattgctcttcttgcacatccaacttcatagggagatttattgataatgctcatattttatagaagtatctactatgctttagtgttgagatacagaaaatcactattaaacctacagttatttgtactctcaatcttttgctgttaaatatgtcataaacttgacagtggtgaattaatggctctaaaaatatatttccatcaatttttcttcatggatttagcagcatttctactgtgcgatacgttttcgttattgactgtaactttcttgaataaaatgacactctaagtttgttagtattctatcactgatttttcattttgtctgatttttcctgttttatattttttattattctttaagttctggggtacatgtgcaggtttgttacatagttatacacctgcgatagtggtttgctgtacccatagacccgtcacctacattaggtatttctcctaattctatccctcccctagccccccaccctctgacaggccatggtgtgtgacgttcccctcctaatgtccatatgttctcattgttcagctaccacttatgagtcagaacatgcggtgtttggttttctgttcttgtgttagtttgctgagaatgatggtttccagcttcatccatgtccctgcaaaggacatgaactcattctttttttatggctgcatagtattccatggtgtatatgtaccacattttcttaatccagtctatcactgatggacatttggccaacatacatacgaaaaaatgcttatcacttgtcattagaaaaatgcaaatcaaaaccacaatgagataccatttaacaacagttagaatggcaatcattaaaaagtcagcaaaagatgctggagagaatatggagaaataggaatgcttttacactgttggtgggaatgtaaattagttcaaccattgtggaagacagtgtggtgattcctcaaggatctggaactagaaataccatttgacccagcaatcctgttactgggtatatatccaaaggattataaatcattctactatgaagacacatgcacacatctgttcattgtggcactattcacaatagcaaagacttggaactattactgatttttaaaataacctgacttatgacccatttaatttctagtagtgtttttttagtcattgtcatctcatttagacctgagtccaaatgccaacaatggctcaccatgctttcttcttctcacccccaccttactacctctctgctcccctatctctgctatgtttcctttatctctaaactcactctactccacttgctgaggcctcattccaaatgctttttcaccttaaggtctttattaccgtgcctaacccaccttcctatagacaattccaaggctcactccctttctccaggtctctgctcatataggaactgaaccaaaaggtcttctcagacctcttattctatgtatctcttttttattcacttaactgttcctaagtatatatgcttcatattgcctaccatgtggctgtaatctctgacacacaaagggttgtgtttgctctgacaccaatcaatcaacttatatacctgtgaattttaaaaggaaatttggataggacttcttcaatgtgattatttatatcctgcacaggcttattgatatagaacacacccaagctcaactttagaaaaaaaatcctgcttgagcattttgatttattcttcctaataagcaaactaaagttgtacttatggatgttttccatttttgtttatacttatgacaaaatggagaattataagataatgcattttttttttttcactctgtggccaggctggagtgcagtggcacgatctccactcactgcaacctctgctcccaggttcacgtgattctcctgcctcagcctcatgagtagctgggactacagatgcacaccaccacgctcagctaatttttgtgtttttagtagagatggggtttcaccatgttggccaggatggtctcaatttcttgacatcatgatccacccgcctggaccacccaaagtgctggtattacaggcatgagccaccgcgcccagcctagatttacttttgaaaatccatgtgttattgttcagccacaggctaaggtaaaggttcctttgttccaagtttggtttctgcatgagaatgtcttgaggttttgtcctctaacgcataggccagcatcttatgcagctccccattaaagctctagctcagatgaaagcattgttaatatctgcttttgaacaactccttctcaaatttaagccattattttggggccttttccctactaaaacattaggaggttctatattttctgtaagaaatgtggccttccctgaagagattcatatgacatcatattctaattttatattcacttatattcatttaataatttcattagaaaacatggggtctatgatcagatttctatatatggcccgtggagtttcggaggttttaagttcccttcataagttcctcttttaattgaagtggaatatgcatatagaaaaatatacataagtgtacaacttgatgcgttttcttacagtaaatacacatgtgtaacagctatcaggtcaaaacatggaacagtgagcaccgcagaagattctcttatgcgttttactgacttactccttccaaaagttaaccactctcttcaattttaaacccatggaaacattttgcccgtttttgaaatttaattgaaagaaatcatagtaggtataatttgtctgatttatttcactcaaatacattttaacgacttcatcttgtatattgtgtgtagctatcatttggtcattttcattgctctgtaatatcccatcatgagaatgtatcatagtcacttccagtttgggctatcacaaatgaaactgctatgaacattctcacatatatatgtgtttttggcaaactgggaaatgtatttctgtaacttgtatgtctacaatagaattgctgggtggtaagaaatgtgcattttcacatttagtagatcatgcccaactctttaattagttgcctgaattatatttccagaagttaattgtgagatttccagttgatccatgtcctcatcaacatttggcattagtagtctagttcagtcattttggtaattttgtactggtatctcattacagctctaatttaaatttcctcaagttactgctgaggttaaacatttcttaaatatgattcttgaatttgtgaacaccttttgtgttcctgttcaatttcagtttctcattctagaaaacctaaaatttaaaaaaaaaatcaagaaaaacagaagactgggatactccatatgtaaatgtgtcagttattctctatagatttaactcaatgttaatcatacttaaaatgaatgtacatgtaaatggaaaagattacaaaacaaatacaaaaatagaaagggccaataaccaataaaatctcgaacaaagtgggagaacctagttcaccagatactaggctgtattataaaactacattactccacattacatgatatttgtgtgtgtagagagagagagaacaatgcaagagaattgaagtgcaaaaacagacccacatatgtacggacaaatttttaatgacacacttagtactgtgaagcaatgaggaagcattatttttaataaatggtgtgttaattagacttcaaataaaataaatactgagtcttaacctattcctcacaccatatgcaataatcaatttcaggtaaaacagatccaaaaacaaaatggtaaaacgataatggttctatagataataacctaatatagtatcataatggctttgggtaggccagtatttcttcaacaggtcataaaaatataaagttttaaagaataaactatatccaagtggagaacttgtttttattaatattaaccattgaagtgagtaaaaaggtaatccacagaaaaggaaaatacatttgcaactcaaaacaaagggctcatatccagaatatagcaataactcaattttgatgaagtccaagttaacttttctctttttgaaacatgctttggattcaggtatcataaatacttgcctatcccaaagtcatataaatttccttctatatgttttattgccaggatttttctggttcccttggagtaggcagatagccagaaatgagcaggcaagggagccccattgagaaaagaagtcctgaagatgctgtttcactgagtcagtgctgcctgttgacaatcagcgaaacggacaatgaatacacacactgtccacactgattatgtctagccttgtggttgggctcctctagccccaaaggggacttctcaggccctcgccagagataaccacgctagggattttccccactgacaagcatgcacacactcctccaaaaacttgccctattcttttgctcattgtaatagtgtaaacaaacaaacaaacaaaaaaacccacacacccctgggtggagattttagatgccaatgagatgtggtatgtgtgctagcatgtacaaccagagcatgtgtgcccaaaaaacctcccaaaacatacttgcaagtaagaccccccccatacaccctttcatgatttatcacgtaggagtctcaaagttccccagcactagctgctgctggctctttgttcccttgtgttcgtgtgcattcagtgtttagctcgtacttattgagaatatgtgttattcggttttctgtttctgtgttagtttacttaggataatgacctccagactcatccatgttgctgcaaaggacatgatctaattcttttctgtggctgcatagtattgtatttcatgctgtatatgtaccaaattattattatttttttttttgatatggaatctcgctctgcctcccaggctggagtgcagtggcacgatctccactcactgcaacctcagcctctgggttcaagcaattctcctacctcagcctcccgagtagctgggattacaggcatgcaccagcatactcagctaatttttgtattttttagtagagacggggtttcgccatggtggccaggctggtctcgaactcctgacctctggtgatctgccagcctcggcctcccacagtgctgggattacaggcatgagcaccgcgcccgacctgtaccgcattttctttatgcaggattgagttttacaggatatcccaaagtttgtttttttaaatgacattttcttgctggggacagtcaagctacaaataaattaaatctaataattctgtgttccgctcttttcttcactgctacattttgaaacagaatatgatattttgatatttcaaagacattttctttgtgtaactttaatattgttaacaattctcataatgtcaatgacactgatatttccaaagagtccatcggactaataaacaagaaaatcagctcatagattattctggctgcggagtgaaaaatctagttaatttcttcctaagacaaacatctctgtaaaataactttcataggttaaaggtgacaatgaccctgaattcataaaatcagccaattaattgctgcacagtttccatttccatatcttatgtaatgtcatctccctgccagataagctgagcaacatttgggggagtacatgttattattaatctatccctgcttatggttattttaagagtaagtgatcaacgtactcaatgtacttgagtttatctttgaaagagagaggtaatgtaattagggagctactaagtgcctggtgaaatgtattggtcgattagacagattttaggatgttaataagaaaggaaggctgcctccaatgccatgacacaggggaagagtcaccaagtggttcagaggagattagaattcctctgacctgcctacttggtttagctgtgactgtttacttcttctaatgcaacacacgtattttaatccagttaaatctaaaccaaaaaaacaaatctgccattcataccccaagtaaaaatagtgatgtttctgtataatttatatgcttggagacagcgtttaataagtgttggcttgatttaaacaaacatcattatcaggtttgaacacatttagtacataaatatttggtatagaaaaatccgtttgttgcacaaaacactgccgtaagaaacagagttcaccgggcacggtggctcacgcctgtaatctcagcacttcgggaggctgaggcaggtggatcacctgaggtcaggagttcgagactagccttggccaacatggtgaaaccctgtctctactaaaaatacaaaaattagctggccatagtggcatgtgcctgtaatcccagctactcgggaggctgagacaggagaatagcttaaacctggaaggcagagtttgcagtgagccgagatcacgccactgcactccagcctgggacagaagagcgagactccatctcaaaaaaaaaaaaaaagaaaagaaaagaaaagaaaagaaaaaagaaaaagaaaagcaaagtaagaaaagaaaccgagttgactgcaggactttgtccaccaaacacagcttcatgaagtaaaatctgaaaacagggagcagcctatcaggtcaggtctatgtcttttcccttccctctgtggcagcatgcatttgcttcctgaattatattagccacaatcaggcatacacgaattacaacatgtgctctcagtaagaactggtctgatttacaagagaatttgaaatactttctctgcatttggggccaaagccctcactcaaacatgaagcatgctgtgtcacagcatccagaccttgtccagggtactacttacattattgttctgcaaaacccgcagtgccttgttgacattgttcagggcatgaactcttgtggatcctttttcttttggctgagaacaaaacaaaagagtgttcactgaccagcagagagaccgacaatctactagaaatgaaaccatttataatttcactattaagcttgaatattgtaaacgaacagagcctgtgaggcattaatataatgaatctaaatactttgcgctaattgtccttggcctggtacgtttttagcataaaccaaccactctaagaatggcaacactttttctttacaaagcctattttggtatgattgtttcttcattctatagcccagttggggattactgcatgaccaccaatgacagaaacatcagcatgcataaaaacattttctagtaagatagaaaaacaattcccaaactttttagaaaaatctaaaggagatttgactctagcaaaattatataatgccaaatagggttaaaggaaaccttttctgtgaagattaccttaattgtccttgtcactgaagctctaaacctcaatcactttggttccctaattttattctcaatcccaaaagttgtatcttatcctgtaatttttaaaccaacatctgcatagttcattgtaatatacaaattaactcatttattaagttgtagagttttagaaattctaccattatgataacctgttttatttactctcattttcatttcttttaccttactacaagcccttattagctattgcccagagaaatctaacctctttcccttctccactcactcaccatttttttcatccttccttcataccatcaacaatgacgttcctgaagtaagcccactgccaatgcaaaccacttgcaaagttctcacctaaacatttgggtgattataggtaacagttaagggcaagagctacaaagctgactgcctgggttcaattgtcagctctgctgtttttgtgctgtctggcctacataaaaaatttaatctccctgtataccagttttctcatctgttaaaaatggacttaatgaaaatattagcaagaggcatacacaagttacaacatgtgctctcaataacaactgctctgatttacaagagaattcgacatactttcttctctgcatttgaggtcaaagccctcactcaaacatgaagcatgctgtctcacaggatccagaccttgtccagggcactacttattgttcatattgctcaaaccattgtacatatggtttctggcagaattcagtgtgtcgatatgcataaagcactaagattggtgcttgtcacatagttggtccaacataaatattattgacttcgtagtatgtgccaagtactttgaatgcactacctttaatccccgccttgcaaggcagttagtttcatccctattgtacagaagtgaacctcaggttaaaatatctaatatatagattaccatataactaataattggtggagccaggacccaaacttttgtctgtgtctgtagagccccagtcttgcaaatttatttccttcttctctaactaccttgtgcatgcaccaaacaaatatctatatttctgtgtcttgcatttaactcctatactttccagcaaagctcctggtctttctcaagtagttcctcaccctagaactccttatcatttgcactgcctgctgaacaacccaaattaagctaaagccatcttactctccaaggtaacttgcctgatatcctttataacacagtattgacatcttgttcctttgatttcacaaaacattaaggctaaccttatgaaccagaatctccatttttacctcttagattttcctccaagaatgtcagaatgatgttggtttacattctgatatttctcccactttccaccaaaaagaggaaaaaaataagactttagatttaaaaaaaaaaaaaaaaaaaaaaaagcaacagccagacatttggggaggctgaggcaggtggctcattgagatcaggagctcaagaccagcctggccaacatggtgaaaccccatgtctactaaaaatacaaaacttagccaggcatgatggaacatgcctgtagtctcagctacttgggaggccgaggcaggaaaattgcttgaacccaggaggcagaggttgcagtgagccaagatcatgtcgctgactccagcctgggcgacagagtaagattccatcaaaataaaaaaaaaatacatgaaagaaaaacagcaaataaccaatcttcttgtgtatatatagattgacagtatacaagtttaatggtaattataggactttaaagttttgaaaataattactcaaatcagttctctgcctagtagttagaccaaagccacatatttcctttcaattatgtaattatatagtcacaagatttagcaaaattttcctttgtatcatattcaaacattaaatgtacacatgtgcatatgtattagaaccaaacatagtctactcttttaaaaagctgcagtttctgatcctgaagtgggaacttaaaatctgcccctattagagtctccttggggagtatttcttattttatgattgtaaggcaagtaccttccttttaaccctggggatgtcctgagccaataatccaaatgcagatgcttctgagtagaatactaaaatttctgttctatagtatacatgcctcccattaggagtagaagatatatctctacagaaactattagaattcaagacaaggcatagcgaattggagttctgggatcgggagcatttgttagaggtgattctgctttatgagaaaggcaaaatcctcagaccagggctgacagatctgtgattaggacaaacaatggtgaatggattctgttagtagcagtatctgaaattatgtaatctacactgccatgtgtaaatgtttggtgatttttccctaccactagcttaccttatactggccaatctcatggatattttgtttgatatttttttctttaatgctattactaattaggttcattttgtcttagcgtctatgtatgtatatgcataaatgcaaatcatgtggattttttaattttgccgaaattagtggttttttctttatatcaaatgggtagtgtgccaacatcataagtttagagaaaggcttatctcatatctgagtataaacacccaaatcatgcttatgaattacgaaaggatctgaaattcattatcttaaacattatgtatgaaatttgttaaccctgactaaattgctttgggtgatagatggattgactcagtcagggaaatgaccagaggattgcaacacaggagaagtgatcacgcagatacctggaagtgaagagacaacagcctcctaacagagggccaggacaagatgagtaagccataatctttgaaagatttttcacgaacatttggaagacactgggacttctgtattcggtaacaaagtaggactgacttcagaatacaggagaaacgagatacacagacacactgatttctgtacatatgctacgtatccatatatatgtaaattgttcacagtcataggagatgaattacacacaaatctatctctaactagtgaaattaagaccaagtttacatgatgacctcaaattggcgcccagcaaacagttcagctataaggtattaaatctgattttcccccttgactaaagttattatttcaatatgtcatcaagttgttcttctattagtacaagttcagacttcttgaaaaaaatggatccgttttagtattaatctcacatagctgaagataaaaaatgaaagcataggtatgtctcttctgtataggacttcagaatttaattgaggagggatgtcagtcatacatacactaaaaacaagacaaaaatgggccttctgtggaatttgggagggaaaaattagcaaaggtaatttgggaaaagctttactgaggtgaaatcaaggtttctggcagacagttggggtagacagaagtacaaaaagaaatacaggcaagtaaaataatacaggcaaaaacccagagatatctgacaatatataccgagaaaagagtggcttagcgttaagtgttacaggaggcaggctggggtagataggatttttgctaactgactttgaacgacagcttcagtttgtataatatgacaaaatctgtgtgtgtctgtgtgtgtatgtgcatgtgctggggagttgtaatgaagggcaaagataagagacgaaggctatgatttagcagaatttgataggtagaacagttatttatgactatagactgggggcttaaactctactttttagaatagcaatctaagacgattatttcagtcaggggatttcaatttgagttctttccccccccagtgtaagaccttgatcaacatgacttcactgatctgtaatcatgtatatcaatcatgtatcttcacaggaatgctctgaagttagacaagataatagttcaagaggaagtgatattttcatcacatatgctatcacgtattacactataatgcctgtaccttattttgctatcccacatgtataaactcatacaggttccttgtaaaataacttcaaaaatacacaaaagtacaaagataatttctcaagtcattatgtataaaagccttcattaagatatttgataagatagataccaagtagtaaaactgaataatatctattaatataaattgtattactgaaatttttactttttctgcaggcggtagagtatgccaaatgaaaatcatacgaggttgctttactaaggaataggtattgctgtttcaatcagtacctagtcattctactagatgtcataaaactatgttgtcagtttctggtctgaaattctactaagtttaaagttaactttcttaaaaataagtcacataccagtttttgccctgtcaggccttcgaggaggtctaggaggcgcctcccatcctgtaggtcactgaagaggttctcaatatgctgcttcccaaactgaaattaaaaaaaatacactcaatttaacaaagcacacttccaatgatacattttcacgattatccccttttgaaaactaaagctatatttaaggataattagtgtgcataattaatctgccgaagatgacggatgaaaaaaggaaagttcaaatgacaaaaaaaatttaaaaattttatcataggtcaagtctatttgaattagtttgaatagcaagagtaagagatttataccctaaatgatctaattaattcactgaaatgaatatagattctatgaaggagagaaaaaatacaggcatgatcaaggcagttacgggtaaagggaaaagtaaatacacaaagaagcaaaagaccacaatctacctgggtgggtacataaagtttaaccattcttggaatataccagtcagagtggttcgacatccttatcactcaaaacatgcttgctgtgcatacacattttgcatgctatgacctattctcatactggataactcaaattttaggaatatcgggtttaattaggtttgaaacaaccctgtgagagcttttcatctattttactcagttctttgctcaggaattatactaaggaaaaataatagtcaataaataatatttaacatttttaacgtaaatactcatgagacacactattaaatgagtggatttcataaccgttgtggcatttctgagattagcagtaacatacttaacctctaagtatctcatgtaagatgagtatgtggctctttgtcatgaaactagaatggggtaaagccaaaattatggctcagatctgtctaattctgggttcttgttctttcaatcttatgttgcttccttgtccttttataacctactatttgattatctttctaacatttgtctttcttttgtcatacttcaccaaatcgttttctgcttaaaaccctacaatcccctcatgaggtaattcccagctttttcatcacctatctggaaatccctaatttaatcagtcaaagacatattgagcatgaataaacctgagctaggtactgaatcatatgctagtacatcagacataggcccagaccctatagaacttagagtccagcaaagaaaatattcctaaaaggtactattacatagaagcattagaaaggactaaagaacatgtaacagtgggagctctcacaagccttgggatcaacaaatactttccaaaaaacgtcaggtgatgggtctaacattagcctttgggtgactgtgctctttacatacactccttggatcacatataaactttgaatttcacacaagtcaagaaaatccctggtttccaggcaaaagacatcccttaaacttccacgattaaaaacataggatttagactattcctacaaccaggtagccatgtcaatgacaagacctgtaaatgcccgggtacttcaagcagggaacaatgatacctgcggcaaccaaccagtccctgtgtgcccagctttgtgaatccagccacatatatacttagacaaaaattatgagttattcttttgaaattctactcaaatagatccattttcaaattccatgggaaaaagaacataacacaaaaccctaacatgctagaatttttaaagaatagctttactaggagggaggcagaacaagacggtcaaatacatggaaccttccagcaatcatctttcccgctaccgctgctatagaaacaccaaactgaacagatagccacacaagcaagcacctacataaaaaccaaaaatcaagtgagcaatcacagtacttgattttaatatcatatcaaggaaagaggcactgaagatggtaggaaagacagttacgaattgccaacaccacccctcccccatcccctggcagaggccatgtctcatgtagacgatctgtgtgcttgcaggagggagggcgcaggattgtgaaacgttgcattggaacccagtgctgccctgtcacagtgggaagcaacacagggcagaattcatcaagcgcacatagagggcacatttagaccagccctatccagggaggtatcacccatctcagcagttagaagctgagttccagctagtctcaccagtgtgagctcaagcactttggggtcctaaataaacttcaaagggagtctaggctacaaaaactgcaattcctgggcaagtcttggtgtcgtgctggactcgaagtcaggggacttggtgggcacacaacccagtaagacaccagtgcttgtaccaccccatcctctaacccctaacagtgcagctgacagctttgagagagactgcttcttccacttgaggagaggatagggacagtaaagatgacattgtcttgcaacttggacacaagctcaaccacagtaggataaggcatcaggcagagtcctgagaccccccattccaggccctggctcctgagtgacattcttaaatacacccagggccagaagggaacttgctaccttgaagagaagaatccagtcctggtagaattcgtcacctgctgactaaagagtccctgggtcctgaataagcagcagtagtagccaggcagtattcaccaagtcttgggtaagactcagagccatgctgtctttgggtgtggcccaatgcattcccaagtgtggtggccatggggatatactccttgtgcttttggaaaggagaggcaatagagtggactttgtcttgcagcttgggtactagctcaaccacagtcaggtagaccatcaagcaagctcctgggttctctgattgcaggccttggctcctggatggcatttctggactcacctggggcctgaggagaacccactgcacagaacggagagacccaggcctcgcagcgtttactcctagttaactaaaaagctcttgggccttgagtgaacatcagtggtagccaggcagtactcaccatgagcctgaggcagtggtagccatggggaaaaattcctctgcttatgaaatgggaaaggaagaatgggacaaactttgtattgtggcttgggtgccagctctgccacaatagaagagagcaccagatagattcataaagatgcaacttcaggccttggctcctagatggcaagcatcaaaagtcaaggataaagacaggatcctaaaagcagcaagagaaaagatacattccaaaaagcttaacaacaactagtaacaggcttctcagcagaaaacttacaggctaagacatgtcatgccatatttaaagtgctgaaggaaaagaccctttatgctaggatagtgcatccagtgaaaatctccttccaacaagaaagataaagaccttccaagacagaagctgtgggatttcatcaacaccagacctgttctacaagaaatgctaaagagaatttatcaactggaaagaagaggaccttaactagccagaaaaaccatctgaaggcacaaaactcagtaagtacagacaaacacaaactattgtaatactgtaattgtgatgtatgaactactcatatcttgaataagaagagtaaaaaaaggaagctttcagttaacaaataactctaataactttaagacatagacagtataatgagatataaacaaacaacaaaaagattaaaagagacgaagtttgagtttttaattagttttctctttgctttcttgtttatgcaaccagtgttgtctgtttgaaataatgggttatagtgtttgtaaacctcatggtagcctcaaataagaagatatactaagattcacaaaatttaaaaagcaagaaataaaagcatgccactagagaaaaatcgccttcactaaaaaggaagacaggatggaagagaaagccacaaaacaaccagaaaacaaaatggtaggaataagttcttaataataaaactgaacataaatgaaataaactctccaatcaaaacacagtgacagaaaaaaaaaaaaaaaaacaaacaacaacaacaacaacaaacaccaagactcaatctgttgcctacaagaaacacgcttcacctacaaagccagacttaaaattaagggatgtaaaaagatattccatgtcgatagcaaccaaaaaagaacaggagtagctattcttacatcaaacaaaatatatttcaagacaaactgtaagaagagacaaagatcaacatataataaaggaatcatttcagcaataagatataccaattgtaaatatatacgtaccgaacaccggagcacccagatatataaagcaacattattagacctaaagagagctggaaacctcaataccccactttcagccttggacgtcatcaggcaaaaagtcaactaggaaacattgaacttaatctgtactacagactaaatgtacctaataaatatttacagaacatttcaaccaacagctgcagagtgtacattcctctcatcaccacatggaggattctcaaggatgggccatatgttaggccacaaaacaagccttaaattcaaaaaattgaaatataaagtatcttatctgaccacagttgaatgaactgagaaatcagtaatgaggaattttgaaaattatacaaaacacaagggaattaatctatattctcttgaatgatcagtgggtcaatgaagaaattcataaggaagttataaaatttcttgaaacaaaactgtaaacacagcatactaaaacttgtgggctacagataaatcagtactagcaaagtttacagcaataagcacttgtatcaaaaaaaaaaaaaaaagagaaacaatacatcttaaagaactagaatagcaaaccaaactcaaaattagattgtgtcatgaagacatgcaaaacccgaacagaccaacaacaagtaatgagatcaaagatgtaaaaagtctcccagtgaagaaaagcccgagacctgatggcttcactgctgaatgttaccaaacattgaaacacctaatactcaaactattgtgaaaaagaggaggaggaagtacttctgaactcattctgtgaggccaatattagcctgacacgaaaaccagacagatatccagaaaacaaaactgcaggctattatctctgacaaatactgatacaaaaatcctcaacaaaatactagcaaaccaaattcaacacaacattaaaaaggtcattcgttataaccaagtggtatttgtcctagggatgccaagatgggtcaccatatgcaaaaaatcaatgtgatagatcgtatgaacagaatgaaggacaaaaaccatatcatttcaatagatgctgaaaaagcatttgataaaaattcaacatgccttcatgataaaaactctcaaaactgggtatagaagcagcataccttaacacagtaaaagccacatatgagaaacccacagctaatttcatactgaatggggaaaaactacaagacttttctctaagatctgtaacaaggatgcccactttcactactgttgtttaacatattactacaagtcctagctagatcaaagaaagaaacaaagggcatccagattgaaaaggaagaatcaaatgatccttgtttacaaaactaggaatcccattacctgacttcaaattatactacagagctatactaaccaaaaatgcatgctaatggcataaaaacagacacatagaccaatggaacagaatagagcccagacacaactccacagacctaaagtaaactcatttttaacaaaggtgccaagaacatacactgaagaaaagaccatcttttcaataaatggtgctgagaaaactggatatggatatgcaaaagaatgaaattagacccttatctctcgccatatacaaaagtatcaatctaagtggaacaaagacttaaatctaaggcctcaaactatgaaactactacaagaaatcattgggataaaatctccaagacactggtctaggcaaatatttcttgagcaataccctaccaagcacaagcaatcaaagcaaacatgcacaaatgagacatcaagttaaaaagcttctacacagcaaggaatacaatcaacaaagtgaagacacaacacacagagtaggagagaatactggccaactacccacctgacaaggaataaccaaaatctataaggggctcaaacaactccatagaaaaaaatatatataatcatctgattgaaagaagggcaaaaatttgaatagagatttctcaagagatgacacaaatgtcaaagaggaatatgaaaaggttgtcactatcattgatcagagaaatgtaaatcaaaactacaatgaggtatcatctcaccccagttaaaatggcttatatccaacagacaggcaacatcaatgctgatgcggctgtgtggaaaagggaaccttggtacatcgttgttggggatgtaaagtagtagaaccactgtgaagaactgtttgaggttcttcaaaaaaactgaaaacagaactaccatataatccagcaatcctactgccgggtatatacccaaaagaaaggaaatcagtttgtcaaagaaatatctgcaccctcatgtttattgcaaccctattcacaatagccaagatttggaagcaatccaagtatccattaacaaatgaatggataaagaaaatgtggtacatatatacgtagtggagtactactcagtcataaaaaaaaatgagacgctgtcatttgcaacaacgtggatggaactggaatacattgtattaagtgaaataagccaggcacaaaaacaaactttgcatgggctcactcatatgcagtaactaaaaattaaagcaattgaactcatggagacagagagtagaatgatgtttaccagagtgtagtatgggtagttggggacaggaggagtgggaatgtttagtgggtacaaaaatctagttagaatgagtaagatctatttggcaacacaagagggtgattacagtcaacaatttactgtacatttaagaatttgggccaggcacggtggctcacgcctgtaatcccaacactttgggaggccgaggcaggcggatcatgaggtcaggagatcgagaccatcctggctaacacagtgaaaccccgtctctactaaaaatacaaaaaattaggtgggcttggtggcgggcacctgcagtcccagctacttgggaggctgaggcaggagaacggcgtgaacccgggaggcggagcttgcaatgagcccagatagcatcactgcactccaccctgggtgacagagcaagactgcgtctcaaaaaaaaaaaaaaatttgaagtggaatgtttgtggcacaaagaaaggatacattcttgaggtgacagatacttcacttaccctgatatgattatgcttcgcatgcctgtatcaatatatctatttaccccctaaatatactatgtatccataaatttaatctaaaacaaagcaactttactatacataatatacacataaatcttaaaacagtgccattttaatgaaactttaaggaaagctctctagtaataagaaaataaatttacactttctaatagtgctgccaagaacttcatatctaacctggaataatttggtattttgagtgtaataatttgtttttcaaattgaatgaaggtatacaatgccattaaaatgatgtgtttttttccctcctttggccaggagcaaaatttcacacttatctgagcaaagcatgacttttaaactcatcaaaaaataatcttatgcactgcaatgtgtccattgttgaagaaaatatagttaactgttaactgacagagatacttgtttttatgaaaagaaaaaatccagggtagaaagttgaagtctgtcagaccaagaagtatgtgcgtgataaactgctgtttattcaaaaagaggagcagagactgggaaaggtgagagaagtcttggagtacagaataaaacatgaatcccaaagccatcaggatcatatagcatccaagacacaaggactacgtttgggtttggagacaaagtctaggcaaaggtcaaaaacgcagacagaatcttgctttgtgggccaaacttaaatacatagaccaaggtcttttataagtcttcttttaaaactggaggtaaccaaaatggagagggagtaaaggattataggtcaggtaggggattccatgtacacctagctggggcaccgagagagagaaagcagtgaggtgatagagaaacagttcctgctatcgtattattttcgaaactcacagagtcaatgatatattaaagtatcacaattgaaatccaatttctattagtcatattcaccatattctctaatagagtgcttctcagaatattctaccagagcatccttccaggaaatgaaattgaaggaatttaccctggagtctggcagtataaattacacagtgcctgcaggttttaaatttctttgaaagcatatactttatgctaaaaattcctagagattttgccttcttcttttaatatatgcttgtttcaacgtaaaactatttatttatcatttattttttgagacagagtctcgctctgttgccaggctggagtgcagtggcgcaatcttggctcactgcaacctccgcctcccaggttcaagtgattctcctgcctcagcctcccaagtagctgggactacaggcatgtgtcatcacgtccagctcagttttgtatttttagtagagacggggtttcactatgttggtcaggcttgtctccatctcttgaccttgtgatccgcctccctcagcttcccaaagtactgggattacaggcatgagccatcacacctggacttatgtaaaagtaattttaagtacttttgagtaaaaatctcccccacccccgttcccacggtctgatgtggttttttttttagtgaaatgtgctacatttagcctgtaactttatagacctttcggtgctcagttttattctccctgtagtatgaataccccaggtaaaatctaacatactatttctcttggatggttctaattttcctgcctgcaacttactctatagaattatagatactatagcaaaagtaacccaagtttcagaagcagaaatagctaacttctgaactcaggtctctcactcactcactagctgtgttatcttgggcaagtgacagcctttctgaggcacaatttattcactattagaatggggctcaaattattactccagagcactcccgtgaggttcaactgcaacacataggaacgttatacagatttggcaaatcgtatgcactcaataaatatagattgatttttatgtttcattttaacactatttgtctgcatctctttctttgaccaaattctaggtgtaaaaacgtttaactcggccaggtgcagtggctcacacctgtaatcctagcactttgggacgctgaggcaggtggctcacttaaggtcaggagttcgagaccagcctggccaacatggtcaaaccatgtctctactaaaaatacaagaattagctgggcgtggtggcacacacctgtgatcccaactactcgagaggctgaggcaggagaatcgctagaactaggaaggtggaggttgcagtgagccgagatcgtgccactgcactccggcctttgtgacgaagcaagatctcacacacacacacacacacacacacacacacacacacacacacacacacaagttaaagtcttttcgataatataaaaatattatattagaaagtgcagaatacatgtaaaatgttttctattagtttggcatccctgtgggagtgcaagtcaataggggaaggcattattccctatacaattactaaaactggtgaatgcagatggtacagaggatgcacttagaaacttgctttttcctcccttttcttgttcttttgactatttttaagtattcttttgttgttctcccctttcatcttcaacatacaccatgtctttgttgcaggtggcattttatatcctaagaacaatattttttctttaaaattcaacctttaatggcttccttttcaagtgtatgagaactattttgtgaagcacacaaaacatgaattcctccttgggccaggcgaccctgtagctctctgtcttcagttcattttatgactaagatttcccttatcaagtgaactgagtggatatctgatattactcagtttaatgtatctgcatatatattgtctttgttaacccaaaccacaacacgaaaggacctaaaaacgagacagtattccttccaaatcctttttagtatgaaataaagaaatacggaagcacaaacagtgttcaaaaagaaacacagataggtaggttgacaagtggcataaataaagtgaaccaaatcaaagtggaacaaatcaaagtaaaaaaatttgagaaaggaaatgcatttgtgaaggtgtttaagtggtttctgattcttcagagttgtattggtcttttaacctgaaaatccaaagggatcaatacgtttcagtagaaagtaaagaacacagggataatttagcatgaccttctgattacaaaaaggacaagccatggacataactgtcgctaagaaagtcaagatacttctgcaattacaaatccctagacattggaaacaccaaaaatatcgcaaataccacaaagaattgcaaaactggggattcaaaacttactgaagaacgctgctgaccagctcccagaaaaataaggcaacccattttcatgtaaataggaagctttccgagttgattttttttttgttttcttaaatatgagttggaaaaggtattgtataataaagcagtattctgttgcggaataatatacatagaggaaagtacacgtcttaagtgtacagctcaatgaattgtcacaaaccgaacatatttatattaccagcatcgagatttaagaaacagaatatgatcaacaccctagcagcttcctcacaccccctatgtggaagctcccctcaagaatggccactatgacgacttgtggcatcataggttagttttctcttgaaaggagtcacctaaagatagaaaaatgctggttttgtattttgagttagaatactagtgactgaaatacattagatttatgcagagggaatttagaaaaaagtcacactgataaaatatgctttggaaaacacgggggaatggtatgatgccatgaataagaatgttgactgtacacccagaatgccttgggttcaactcccagctctgcagtgtgatcttgggcaagtaacttctccgtgccttactcttttcatctatagaaagagcatgtatcattacctatgttgtggtgatattgcaaagatttaagtgaacttagtatggcactttgtaagatatattctgtaagtgttagctatcacacgtttattccaaactttctaagccaaataatccatatcgtctataactttccttgtaatgttggcctcaaagtaacagaagggaccaacttcaaaatatgagaattaaaagggttaataaatgtaagatgtctggtatggtacctagcatagaaaatgctcaataaaaacattaaataaattacattccctcctgttaaatgttatcacctggaggtggagaatgacactctcctttgaaatttatatggccatagcaggactttggtaatctgagaagagtttaataagggactgtttataaaaatgagggaaggtataatgaaaccactggaactagtaatagagaagtgtcactactactcttagactcctaagaatgaaaagaaggagagtggtttctagttactacatagagagagaactgagaagagaagattatctgacaggagctttgatattgggtgatggaatttctttcctctctccctctcttaccaaggctctcattggccaaatccaactagtagccagagggcaaaggagcctgttgatgtagtccacagacatcagcctcccaaggaagacaaaagtggagagtagggccaaagaaataagccaaagacattcaccaccctagacatggaagcaaatttcctttgagccaaggagatcaatgccagggatgtccatatcagaaaataaatgaaggcctacgtgttacttcccatgcctcatatttctatctctggtgatgtcattgtaaggaatcatatgtatcactggaacaccgtcgtcttctttaatagtgatatcaaaatactggaatgttttgtggaccttagcagataaaatcagtaggtatttattcattattccttagcgtcaaatacttgtagagacttctctctaccaaaaaaagcacgaaaatctggctatgaagatcatcaagaaaaagccaagttattccttgcagctagcaagtgttcaagagcaaagctacaaaatacaagtttttataatctctccagatataaaatgttatttggcattttataaagcatcttaactagaacccaatatgtatgttactctattaagtacactagaaatgattcaaacagatgtgcattcgaactttaaataggaaaccacaccatcgttaatggaaatcaagttgttatatgtaagtgggatgttatgaacccagaagtatgcttaacaaaaagtcagcatgattcattgtctgatcaggtctatccttaacatgttttgtaataaaactaacttctaaagctaggtctcaattgttttatctttaagttaggtcagtactcattcattttaccaggtattctaaaggaaatattaataaaattatggtaaatgctttatcttatatttttatgtattaatgtaattcacaaagttattttaaaatttgtggaatgattacaatccatgattatactaattacaccacctttaaatatcccctataaaattgaacattctgaaagttaaacccagttttttgttgttgttgagactctgtcaccttggctggagtgtagtggcgtgatcttggctcactgcaacctccgcctcccaggttcaagcgattctcctgcctccgcgtccctagtagctgggattacaggcgcgagccactacgcttggctaatttttttatatttttagtagagacggggtttcaccttgttagccaggctggtctcgacctcctgacctcgtgatccacctgcctcagcctcccaaagtgctgagatttacaggcatgagccactgcaccaggcctaaatccagtttttcttttgattcacatagatacatgatttgcatttgagatagccagtgatggaaatgaaggctaattacaatctatcccaatggttgcttttctgacagaaacggtatggtacaaggttggcaagatgaagcactttgtttcaaagcatgcaaataacactgattcttcaaaaaagaaatctataggctaggcgcagtggctcatgcctgtaaccccagtactttgggaggccgagaagggcagatcacttgaagccaggagtttgagaccagcctggccaacgtggcgaaactccacctttactaaaaatacaaaagttagctgggcatggtggcacgcgcctgaagtcccagctacttgggaggctaaggtgggagagaatctgggaggcagaggttgcagtgagccaagattgcaccactgcactccagcctgggtggcagagtgagactccgtctcaaaaaaaaaaaaaaaagattgtgtttatacacacacacacacacacacacacacacacacacacaaatacacacatataccatgacataatggaatggctcactagacaaacatctatgagtactcagttccagggaaattgcagagaagaaaagtgatatttaggcttcagatctagtagaggaaacattatggacaaagggcatccaaagatgactttaattaatgaatgtaaaacgtatttattaccattcttataatttctcaattaccctacggtgcagttgtgtatggacaatataggtgacaagacacagcttcttcctaattattcccatcctccacctactgggaagtcatccttggtttattcattctttcttcttccatgcctgtaagggtctgtctacaggaagttccaaatcaaagaaattggaaacacagaaaagataaatgtcacataggatacaatatttaaagaagatcttctgtcaaaagtcacagaggataaaatatttaaaggagaacgtctgtcactgctatgctttatttccttttagtggtccaactttatgcaatttccaattctgaagtcaaatattgtcaaatattacaatttttatatgactctacctcatgtatcagaaagatgcgagttacacacatcgactggtttatgtcagcgctacttctgtgtactttttgtgggttgttttaatgttcacagtcacccccattttacaactgatgaaacagacacaatataagtaacttgaataaggtcacacagcaagtaagtgctagatactaatttggacttaggcagtgtatctacagatctctacaccattctttactttgcaactgctgtttaagctgggcttgactatcatcacattcaggggcaagggttaggtgagttttacttgagcctttacgtcatcttttctacaaagatagtttaatatatcttttctttcttctatcatttccaaaaggtcagatacagttatatagcctgccaataaaattgctcctaattgtaggtcccatttgtaatggaaagatagtaacagtgataattctacatatatacattaggaaaattcttcaaagtcccaaattcctattgttatatcatttgacatcgggggtttcattaactcctcaggactccagtgtgctcagcagactcaattactaaatactattttagagcacactgcaaattgttcgaatgtataattcactctaatgtatttgaaaaatgtggctttttatattaactaaagaagaaatatcattcaacaaaaacttaaggctatataaatcaaaatataagaaatataatccttgaagttgataaggattaaatgaggtagtagtaaacagaagaaaaagtttaactagggcatttagtgtagccatttcttaagatccactgaaaagtgccagttccttacttgaaagtcttccatgtgagattcggtgtagttgtaagttaaataatatagtatctggaagcaaataggcctttatttattacagttctataatttaaattttgccagttgtgtgaacactgataaattacatagcacttggcttattttccttatgtgtcagacgagggggatagtcattcaactaaatgtaaccagtattatgcatcatactgtcctaagaaaaatgggaagataaaagataaaaacatactgccactgttttcacagcttttgtaatagcctaggaaggaaatatacatttaagcgaatataattatagcatggtgttataatcctattaatagtgatttttttgtcgtaagtatggtgctggcacaaataaaagatatcttcactggagagaacaacagagtgaaaatccctgaatagaatatacaaggttgaacaggttatcaacaggtagaagtgtaaagggaagataaagtcaagcagaggaaacttcacatgctaaggatcagatgaaatagacgcactgttcaaggaactataagccacttcttggaacgtaagtggacggatggaacatgagactagagaggtacaagacaccccatccgagtgtaccgacttgattaaccacccaaagctgcttaggcaaatgtctgcttgtcttttcttttcaccctttcaaacataactaattttgagaagctcttaccatgttttgcattttttaattcatattttgactgacactttaacatagtattgtttaggaaaaaccaatattggcactgtttaccaattatttgcatgcaaaaatatttggcaaggaagccatactgtccaggagcaactgctgtaaatggtaagttaactacaaaattgggcctagtatttcatcctttcctgaatccataccctttgcaatgtagcattgctgttcttctcatgaaaagttggtatctatttccctgcttcttaaatctgggttggcatttgactcattttgaccaacagagtgcaattgaagtgctggcatttcctctcccaaatgtagacctcaaaagggcttgaacacttttgctctcttgttcatgcctctgcatttaccgtaagagcacatcagagctagacagcaggaggatgagacaagtggaaccgagtcaagttgccctagttgtcccagatgaagttttcccagactagcagacagccagacatttcgcagagctgagctgagatcagcaaagccccttagccaacccccagctaactagagacacacgagtaatcctagcagtaaggtgaagaacttcctggctaacatatgtatttgaaatagtatgttggttgttttaacctactgagtttcaaggtggcttattacacagcaatagctaatatgtgtacatacatatgaatatttgtttctacacagaagatgtctgaaaaattaagccacattataaagatatttataaaatatttttaaaagagccctaggagtttttatgagaaatatcaagctagaaattattttactgctgaaattgaatatgggcaaaagtcagtttctagagatctgactcatgtgctattagaaaagaacacagtcattatattccatgcagttcctccaatgcaatcttgcaaaaaagaattaacgaagcaatagttttgtcagtttcatagaaattttttaaatacagtgtcaaccttaatatatacatacacacacttttttttgggggggggtgggggggtggggggggggggacagagtttcactctttcgcccagcctgcagcgcagtggtgtggtctcagctcactgcaacctccgtctcccagtgtcaagcgattctcctgcctcagccttccaagtagctgggattacaggcgcatgccaccacgcccagctgatttttgtatttttttagtagaaacagggtttcaccacattggccaggccagtctcaaactcctgacctcgtgatccgcccacctcggcctcccaaagtgctgggattataggcctgaaccaccgtacccggccaactttcaaatatttctaaagctacctttcgtaagacttagtgtttaactcttctgttgtagccactgtattgtaaatgcaactaaggttgtattccttgcccaatatgttcatttgacgttcaattggagaagttaaaaaaaaaaaaaagttgactttatttttctcccatttgctagatttttactgtcactttagataaaaagtgtgtttatcttgttttcttcattataagctataatttccagtggtttattcagacatttccaaaacaaaaatagtaaatcaaaaatagttccctgtgaactaaaactgtcacctttagttagtgtttctagaaaaatgcattttaaaataaagttgaataagagccaaaggaaagtagagttgacaatttttttcttacaaagctcaaagaaaaaatttaaaattgccctatgagaaaatcttaataggtacctgacatttcaataggaaaaattagttataactgcttaaatagaagtttttaccaagagctttattacataactacaaaaggtacctaattcagtgattcatctttatcagcaaacatttgctaattgtaaacaatcctgtacaaaatatttttatttcaaagaggtagcaactttccaaaaatattgaaccaaaaggaaattgaaatgaccttggtttaaaatatcattatcagcttgaaaagtggaaactatcaaatagttaaccaactttttaaaagattggtgctcactcacctggctgaatgacctacctctttgaaccttaaatttaaataatggctcggtccacattaaccttctcttgattttagactgtaatatccaatatgggaatttaagcaaaaacttaaagttacatcaaaaatggaaaaatatggagagaggccaagatgaccaactaggaacagctgcagtcagaggctcccactgagaagaaccaaaaccgtgagtgaatcctgcaccagcaacagaggtgtccaggttctctcactgggactgactaggcagttggcatgagagcgcaaggaaaagcagggtggtgccatggcccacctgggagccaaacgcgacaagggaagctcccactcccagccaagggaggtagtgagtgattgtcctaccctgcctgggaaatctttctttttccacagatctgtgcaacccgcagatcaggagatcccacttgcgagcccatgccaacagggccttgggtctcaaaacacagctgtgcagattctcgcaggccactcggatggagacgactccttaagactgctcagtttccgggggcgggggcggccatcatcactgcagctgcctgttacagcaaatgactgagctctcccggggaggggcggcatctaagagaactgccacctaagagaactgagctgctgtggggaggggcagcagccatcacggtggctaccggcttactgagaggactgagctcctgtagggagggcagcagccatcactgcagctccagtccaccatttttccccttcaggtttgagggagactggacagtttgaacccaggaggaattccctgcagtacagcacaccagctatggcaaataatggccagattgcctcattaggccggactctgacccatccctcctcactgggcagggcctgcttgcaggaattccagtaactccagccaggggtttagggaaagaactccgattcccctggacctgagcccctagggggaggggtggccatggtctccgcagatcagcggacttagtctttaccctgctggctctaaagaatccgggaagcccagacaagtgggattcccccaggacagcaaaccccctcgaccaaggggcagccagagtgcttccttaagtgggtcctggatcccgtgcaccctgactgggtgagacccacccccaacagcagtcgctagacaccttatacaggaaggttcctgctggcatctggtcagtgaccctcagggacagagatactagaggaaggagcaggcagccatctttgctgttctgcagcctccttaggtgacatttccaagtgcagaagggacccaggtgaatggggtctggagcgaacccccaacaaactgcagcagccctatagaagagggacctgttaaaaaagcaaacagaaagcaacaacaacagcatcaacaaaaaaaatcccaattaaaaccccatccaaaggtcagcagcctccaagattgaaactagacaaactcatgaagatgagaatcaaaaaacaaaaacactgaaaactcaaaaagccagagtgcctcttctcctgcaagtgattgcaactcctctccagcaagggcacagaagtggacagaggctgagacggctgaattgacagaagtaggcttcagaagatgagtaataacgaactttactgagctaaaggagcatggtctaacccaatgcaaagaagttaagagccatgataaaacattacaggagctgttaacaagaattatcagtctagagagtaacataaatgacccaagggagctgaaaaaacacaagaacttcacaatgctaccgcaagtatcaataaccaaatagaccaagcagaagaatgaatttcagagcttgaagattatcttgctgaaataacaccagcagacaagattagagaaaaaagaatgcaaaggaatgaatagacgcagaaaagtcttgataaaattcaacatcctttcatgttaaaaaccttcagtagattaggtattgatggaacatgtctctaaataagagctatttatgacaaacctacagccaatatcatactagatgggcaaaaactggctgtaggttttggtatgacaaacccttgaaaaccagcacaagacaaggatgccctctcttaccattcctattcaacactgtattggaatttctggccagggcaatcaggcaagagaaagaaatcaaggataaataggaagagaggaagtcaaactgtctcttctgtgtatctagaaaactccatcgtctcaccccaaaatctccttaagctggcaagcaaattcagcaaagtctcaggatacaaaaatcaatgtgtaaaaatcacaagcattcctacaacaatagacagagagccaaatcatgtatgaactcccatttacaatggctacaaagagaataaagtaagtaggaatacagctaacaggctaagtgcaccacctcttcaaggagagctacaaaccactgctcaaggaactaagaggacacaaacaaatggaagaacattccatgctcatggatagaatcaatactgtgaaaatggccatactgtataatttatagattcaatgctattcccatttatctaccattgacattattcacagaattagaaaaaaagaaaactgttttaaaattcatacagaaccaaaaaggagcccatatagccaagacaatcctaagcaaaaataacaaagctagaagcctaatgctacctgacttcagactatactacccaaaacatcatggtactggtagaaaaacagacacatagaccaatggaacagaaccaacatcttggaaataagatcacacatctaatacccaaccaactgatgtttgacaaacctgacaaaaacaagcaatggggaaaggattccctatttaataaatggtgctgggaagactggctagccatattcagaaaactgaaactggacaccttccttacaccttatacaaaaattaactcaagatggattaaagacttaaacacaaaacccactaactataaaaaccctgtaagaaaatctaagcaataccattcaggatatatgcacaggcaaagattttgatttcctgacaaaaacatcagtcaattgcaacaaaactaaaaattaacaactgagatagaactaaaaggcttctgtacagcaaaaaaaaaaaaaaaaaaaaaaaaaaaaaaccacaaaacccatcatcagaatgaacaggcaaactacagaatttttgcaatctatttaccattaacaaaacattcttcccctgcatccttgccgtaagcttcgacctcagccttggatagacccaccctcctccaacctgcaatcttttcccgtgttttttttctcttaatcttggtctatttttcctctctgcttcaccaacagttcatctccctattctttcttcagtgtcttctgaaaccctagaataatttgaatggttgtctttatgccctcagtctcagctattccataacaaactctccttacttagaatttgatcttcatgtttgtttacctgcaatggtaaacaggcttaaggcttgtctccttcccccgccctccccatacttaagatcaagtgggaggtttctattttaacatattaactgatgccttccctcattcttggaagctatatatgtgtacttcctcaagcgtgctactataaaaatacaaggaaagagacatcaaggatcaaataatgtgtttctcagtaattccctggaatctattgataagattagagccctgcattgaaaaatccttagtatattgagcaccaatgacattatctatctcgtaaataagagctgggaagattgtgtaagatacagtttgactcattccaaaggaaatgtttttcaacttccagctgttcaactggaacaagaacagtattgtaatggattatggtaagacacagtcgttgttatgagcttctgacaaagtactgtatcattccactcccactctgagactaagtttcagaaaccctatataggtttagaagaattccagagttaagatgtaccttgcttgctagaatatggtttgggaggtcaaatccactcagtcaccccctccctccccatcataacactagcacagtaggttaaggcatgaatgagtcaggtgtcaaagcaggcgagactgaaagtatgcttctgggcactccaggcatgattaaattggtatgaaaaggacacgagagaggacatgatatccaagggcttgactggatcccagtcatcgttggtggtgacatggggatagagaccaacagactgaatgattacttgtatcagcagaagacttcaagagaggatgactataggcttgtcatccccgatttctggatgtgacttaagtccctttaaatttaaaggttgctaatgccatcatgaccaactaccattgaacattttaactgatgctctgacctcacagctttttgacctgctaagctgcaatgactttgatcaatttgcgtccatgttcatggccagttcatgctttctcacctacctcgaaccatcctaccccatggatcacacacagtgaattgctcacttaaaccacagtatactgttcttgaaacttctgtcccctttttaaaattcaagtattatctacaatgtgacagatatcacatgaggttagattgaataatgatttagtttctgcatttctggagcttactgtctcaagaagatgaacaacaaataagagatgacaacattttacatgctaaggtagaaataaagtcaactgaaaaagaattttaaggctaagctataggaagccctttctgaagagatacaattcaaggtatgatcttaaaaaggagattttataaaaagggaagaattacagatagcaggcacaagatgcacaaagggaagtaggggaagtggatgctaaatgaagttagtgggcaaagaaggataaggggtaagccacagtagagatgttaaactaaatgtaatagagatgcttttacaggctttgggtaggagagatatgatctagtttgtgttttataaagatctctatggctcctgtcagaagacatcaaggagggcaagagaagcaatggaagactccagtgcctcatgcattcattttaaaactcttagtggtggctaatcttatttaaactaatcttagtggtggctaccacctcaccatcaggtaaatctccttctctcactcactgttgatcataattgctttatcaattgttagtcctgattttacccagcctccgattcttttagttccctttttgattgctatgcaattcctgaagtggtcatataacccaggcctgtaggtcctcaggacacatggcatttcatcaccgaccctttcctgctttgctcaaatgtcaggggaataagcccccctcctccttttaaaagctgacccctaaatatgtgcttttgagataattggctaccaacatctctaggatttaattctcttccctcctcgttcacatacacacaggcatctagatatggcaggcagtaggcattagagtgagagagcagacattgaagctacactcaggcctgtttctcagactttagtatatattagaaccacctggatgagcccgttatgacatgcattgcctgttaattctgatccaagtgtacagaggactacaattttgaggaaataattctaggctcagctttaccactgattaagtagccatgagtacatcaaggcacatttctgagcattcatttcttatatgaaaatgaagtaggttacagtggttattctctaaggatactctcagcactcacagtcccctattctgtgtctagaatctaaataaggctaggaaaaaatgcaaacataaaatgataacattgtaaaagctaagaatagttactaaaaattagccaaaaccctttgcttctccaaagtcgaataaaaatcaagtaatgacatgttatgtataattgccatcaaataaaaggaaaggaattttatcttagcctaagctaagggtaagattttcaatctgaagtccacagggacaagaccaagaacaggaacctaacaagtcctttgcaatgatctgaataatgaaacatcccttagatcagagtttctcaacatttgtttgcacatgaaacctctgaagatgttagtcaagtgcagactcgtgtgaggtctaggatagcgcctgaaaatgtacatttctaacaaaacctcaactggtgctcctagattgcagaccataatttgagttgcaaggccttaagtctatccctcacagcagctgtcataccaaattttcactttaacaacaatgaaaaccttaacagaaagtgtttggcactttcacaaaagaacagataagcttttcatgtctttttcttaaatctgtgttcacccattgttgagggtagaacattgcgacaagttcatttttacagagagccaaagtaagattccccaaggaagttttctgatattctctattgatacaaagattgagcttagaaaatgtagaagaatgaacggtcagcatgagccttgaactctggctaccatcaattgtttcctgccaagatgcatctcttttctttcctaaaaactgccagttttctctctcgcctggcttgtttgtgcaaggatcttctttcttctgcccttctcagctagagtcactgacacactctcctcctgtgagatatgcatcactcaataccatggtaggaggaggaaatttacagcagttatgatggactagaaatggccacaaaattatttgacacttctttcatcaagaggcagcatctaattctccccttaaagctcggatttgtcttagcaacttgtctgccaagtagaatgcaacgaatatgatgttataggtcttccaagattagatcattattagtaacttttagcctctttatgggtttcttagaatactcactctgggagccctaagatgccatgcataaaaactgactaccctgaaaccaccatgctgtagaagacatctacaagtcctctggttgacagtccctgctgaactgagcctttcagccattctcacaatggcattaagcattaagtgaatctgtcttgaaccctccagaccagcacatccactagctgaattctgccaagtgatgtcaactgacaccacacagagtagaaaaatcaataagctgaacacggctgaattcctgattcacaaaatcagataaaaagataaaagagatgttattttaagccactgtacttggggtgttttgttacatagtaatagaaaaccagaagagtatcctaagctccctctggaatggaggctctgccttgaatcacagccctctcgatcgagaccttgatacatgtccctcttcatcgactcttgaactctttctggttccctgatttactattgcctatgtttctatttaacagattacaccctgtctcccagcactcagtctcttcttagttacacctgaatttccccagtgcctgtcctgcctagtctgtattttctccttttcctccagcctacactgctataaccttaggatactttcaacctgctgtgagaaactctatgcaaagtgtttccatgataattttctgctcttttcccttctgtagggagatatgttttggctatctctaccagtttatctacttctaatttcactttaatccagtgccaggcccggttgtaagcaccgaagaataaatgaatgactattggataagtgaattagtgagtgaatgaataaataaatacatcaatgcatttataggttatggtctactactccactgaaattgttactttaaaattagtcaaagcaaccagaaaaccgaatggtcttttctcagaccccaagtaaatttcaattcaatcactgcctttggtcaatgtagtcacctccttaaaaactgtttttcttgctgcttctgtgaccagacactttacagtttcctgtgacttctcctaacacttctttgctggcttctctatatctgcacgtatttaaatgtgaattctccaagacttggttttgggttcctttttaactgtgtataatatccttttgccgtatcatctgcccccatggcttaaactccatattgattacccccaaaccattttctttagttgtggtatcttgcctatgatactttctcactgctacacctatcaaacacacactgatttccctcctcagatccagacatattttccggagattattggatatcccatcaatacatcaaagacaatatatcccaaatacaaatcacttccccatcatagttttgcttatttctatttctaaccatatccaatgataccaccatcctctcaatttttcagccctaagacataagttattttcacctcattcttgccacatcctttaattacatcaatactgatatccctgttgtctctagatacaaaatgtcagttataataaactctaaaatggtttcttcacctataatcctcaaatcttgacagttatccaatttagtctatgtagtacaactagttattttcctaaaccgttcttgtaagtactccaaccacagttgccccctagtgctttcttattctgtagattgtatttttgtgttctagccttccactccaccaacacctttcttcaaggctctgtttgaatgaattcttgattcccatgtgccttgccattcctttataaccaactccaaaaaaagtccctcctgatcttgcggtctctcggtcatttgttcatgtcccttaatgacatattgtcattatctgacttgaagttgttgtaggtttcctcactactttatgagcccctggctgaaagatatttttttttaatcccctactaaaactagcattgtctattgcacatagtgaatgttccgtgtttcttaaatttggagctgttgaacagtttcagttttcagctacattcactttttgactgagttgtaccataggtgacactaatctgtgccaaatggggcacatttaaactacttacactattactttaatgttttcattgaacgcaggaatctttgtagcctctaggtacatttaaactttaagataaaaattatattctgtcaaatgatttataatcaataccattgccaattaaaatcaaataatagacacagaagtgcctcaaagcttcaactaagatagacacaaaggggtgccagtggataacagtgttatttcataatcacagcttcccttttccctctagcaattattctgatgcagaatcagtcttaagaggtttctgcagctagatgtaaacaaagaagtatcattacaaaactcacttgactacacttctgacaccctggttggggaaatgtatatggattgatatgtctgactgacaagaactcaaaatttaaatgatcccttgtccaagagccctgtggttatcatttagaattcatctgcacaagtcattaagtatactctttggaaaactattttgttccggaaaaatgtaaagtcaagaagcaggaatgctaacatttgaaaaaagcttctttaataatgctataattctgaactttttgtttatattagaaaatattttttcttttaactctagctatagtacaattagagatgtttcaaaattattcaggtaagtgcttaattgggtccacgtaatcttctgaaagttagccctttagaggttatagccaaaaaatcgtgttttatccagatccactaagattccattaacacttctgcgtgcccacctccttggcttttgtggtctttgcttctcaaaacttctgtatctacatctctttagatgactgtcttcaggctagtaaagctgctttgccaacaaaaacagagatccggaagtgccttggtgtttatgtcaccttagggtagtcttaaggcaatgactggtgactactggaatacaaaagcccagctccttctgtatcaagttgcaacaagctgaagcatagtttaggcccaggttttcctgcagaaccagactgaggctggcactttgcctgcgattgctccttgcatgatttcttccccattcctattctacttctcttgctcacctacttgccatccctgagaacatttccttaattaaactactttcatgcaaattctcctctccacatgggctttaccaaaacccaacctgaaacataagcattcctctaattacagtaataaaggcatcagatttctatttgaaaatactaggaatgggccgggcgcggtggctcacgcctgtaatcccagcactttgggaggccgaggagggcggatcacgaggtcaggagatcaagaccatcctggctaacacggtgaaaccccatctctctctaataaaaagacaaaaattagccgggtgtagtggcgggcgcctgtagtcccagctactcgggaggctaaggcaggagaatggcatgaacctgggaggcggagcttgcagtgagccgagattgctccactgcaccccagcctgggcgacagagtgagactacgtctcaaaaataataaaaataatatggtgttaaactgattaatctttaacttcgacagaatgttagagttcaaacctgtagctctatggaggttttgattaccattataatccattaacacaatatgttactaagatagcatttcagagcacagtatgattttcttgtagctatactacaaaactacaatactacagtatctgtattactttagaaaatctctaaaaaagttgtgaattatactgccaatggtttgattagatagaatcttactgatttttaaataatatcaaatttttccatctctaatcatgaaaagagtggtgaggtagggcaggataaatcgtaatattggggccaggtgcaatggctcatgcctgtaagcccaacactttgggaggctgaggcaggtggatcacgaggtcaggagttcgagaccagcctgaccgagatggagaaaccccatctctattaaaaacacaaaaattagccgggcacagtggcaggtacctgtaatcccagctactggggaggctgaggcaggagagttgcttgaacccgggaggcggaggttgcattgagttgagacagcaccactgcactctagcctaggcgacagaccaagactacgtctcaaaaaaaaaacaaaaaacaaaaaacaaacaaaaaaaaaacaactaatatttgtatattaatataaactcctgaatccctcatgacataatatccatgtgtatcaagcctttttattcctgcatctgttaccgttattctccctatgcctctcacagccagaaggaaaactgaaagtctactatcttccttttggtaaaaatttgaaaagaagggcattcaggtagagatggcatttattaatgccagtgactgcggcagactgttcttgggccgctgggaagcctgtggtgataaacagcattggaggaagaaagagtcaccatttacatatggcacatgactctcatcacagcttgtgttgcttattcaccagtttgactttgcccttgccaaaaggttagacaacctctgctatgccctcctcatcctactggcaaattaccactttgttcccattttatgaaattattgaataaagatcaccattaatatttgtcttttttaataccagttattgacaagtgatcgtcgttcattcaaaaaatatttattgaatgacagttaaagagcctttactgtattttaatttccaataaacatatatgtgtcacatatttttaaaaatatggagaagttcagcgtttttgttttgctttactttggtaggttaatgcctgatgttcataatcttttccagttcaacaggctgggtgagtggtatggtaccataaaaaggatgatcagctggaaatcaagaccttcaatctctacttccattccctctaacaaacagccatggcatgttgtcatttaattctgagagagcttcatttccacatcttcagaaagacagaacaatgctagatgtacttgcatgtattccaatagtgattgcctttcagaccttcctcttctcccatttgaatagacattagcctcatgagtgacctccacacctgtactctccccatacacgattctgcatatagccaccaaatgtaactttctaatatgcaaaacataaaaaaaaacttcctggtttttttgaacacattcatctcaattgagcaaggaatcatccatccacattgtatccccagtccacctttcccgcatccttttcaattttttgccaattgcccatatcccaaaacctccattacggtcatgtcaaactacttactggttcctgaactcaattggtttgtgacttcatactcctcagcatttttttttttttttaatcagccaataggctgaaagctccaacagggccaaaaaaaaaaaagcctttttcagcttagtcttcttagcaactaactgattgtctgcctataaaagatgtttaatcaatgtttggaagagatggacttgaatggcctgttgtactcttgttggcatgaaaatccctttaagtttctagtctatagttgatatcaatttcaaccccaatacaaccctagccaagcaaaattcgtctcttcttccttctgctcccatgcatacccccgtggtaggacatactatatagtcttgtaattgcttttgattgcttttgaaatacctatttttcccatttatatgccatctcttaactacagtgccaggtatatggcagaatctcaaaactgagttaaaaagactaagatttctgggctaggcgcagtggctcacgcctgtaatcccagcactttagacggccgaggtgggaagaccacctgaggtcgggagttcgagaccagcctgaccaacatggagaaacctcatctctactacaaatacaaaattagccaggtgtggtgacgcatgcctgtaatcccagctactcaggaggctgaggcaggagaatcgcttgaacccagaaggcggaggttgcggtgagccgatattgcgccatcgcactccagcctgggcaacgacagcaaaactccatctcaaaaaaaagaaaaagaaaaaaactaagatttctttcaaacctgtaatctgatgatgattgtatgcaattctttttaaaaagctaaaaatcttagattgagttatttatgaatacaaacaggtatgaagcagaaaccacgaaggcagctggcaaaaaataccagagtaagtacagctaggaactgtagatgccagtgtcagtctacatctttgaactgtatgaaagagcctattggacactaagtatttatcaaattctttctctttgaagctagttctaaaaacaatagaaacaaaaggaattttagctaacttgctttaccttggctacagaatattttaaatctaacattccaaatagttcttaaagtattctgaactggtttctttctgtgaagacaattatgatttctgagtctatgaataattgtatacttacgcaatgttaggacagtattatctgtaaaatgatttgatgttcaatatttctactattaatcttggaaaagtaaaaaatatcttctatcagaggaaatctaacactctcaaaaataagttaaatatgatacaatggcagttctacaacatccagatattcaatagtaggcagcaattattacttgccataattcacatctttgaaaaattcaagagggcaaactaattttgccaatgtgaaggagctgtaagaaaaattatgctttaatggaaatataagatgtttttgttgccttaagtattgctttttaatccttgaaattcagtcaaatacttaataattattttccatatatcttattagacatattagcactcatgctggttagagattttatcttcctcagagccataccaacacacccttctaaaccctactttgcaacgctgaggcaaagactctgcaaaccgtacttctggctttactgactgactctcagaatctaaaggtagggagcaatagagggagactgcaagcctggaggagggacaaaggatttactcattcacactagcttcccatgcacttactgtccttattagcagttccctagacgtgcttcttcatgcctgcagcagcactttttagtaacaagctattcaatttagcttgtgttttgtttttcaaaagcttagagaatcagcttcatcgcccctgctgcagaaataccagcaccacctggctggcagaggtccgggcctcagtcccattgggcccttcctgctatcccagagagggtagcaccagccacgtagcagccccctactcagacctgagctcagctttgtagagtccttcctcaagggttctaagtgttagtaattctaaccttttgtcttcccagccctaggagcggtagctactttgtgcacttgctacctcttctctttgtcaatttttcaatacctagatcccaattcctcttgttacattattttctgctacagtcactcaagtggtttctgtctgttaactgaccctggctgacacatcatcccaaacccaaaacttgtcactatcaaaatggaaatacattaagtgttgggtctgtgtttaatgggtaaggatgatttctcattcttccaaagaccacatattatattccactattgttttctactacttttataaaataatgactaaatatagatatacttcagtacaaggatatttgatcttctggacagccgtatccatatgtgcattctttctgtagatggaactcagttgtattagagtcaaaaacttttttaaaaattctaaccatggacagttgaatcaaatctagccctgtagttatttttcaaagtcaacatgaatagtaaaaaataaaatattgtcaaaaatccacctggaaaattgctataccatccatactatacacataatatggattagattttaaatactgcgtagtcacctcctgcacaccaaagtttaggaagacattgagctaaactcaaagagcaaaaagccagagtgtatgcagctttcttaacatgcaattcttcctgcctctaaggtaagccctagattgttttctttacctgcagggctttctgcagtatgtcttaatagtaaagataatccagcacagcatttgtaatatgcttgtgatcaagaatggatggaaacaggatggtatagtcctaacttaagcatgtaaattaattgcatctcataatgtcagccaatccacactcttagtcatacagattaaagaaccaaaaggaacccaaggaaatcagaaagggtaattctgcttagaaagttgctcttacatttcatatacatggttgaagtttgacctcaaaaaaagaaaaatcaatttcaggcactgaacggcaattgtgtaacttatttattaaatttataatacaatgaaatctgagttttctattactctcatttcttatttggacactggtaattgcttctttcttatgcatttttaaagtataaatcctgatactagctggcactaccccaatattttttccctttaactttggaattttccttttaaaaaattgtcattctagagttaacatgctaccagcttttcacaaattaaatttgttgttagaaaatggcttccatggccaggcgcggtggctcacgcctgtaatccccgcactttgggaggccgagccaggtggatcacgaggtcaggagttcgagaccaccctggctaacacggtgaaaccccgtctctactaaaaatacaaaaaattagccgggcatggtggcgggcacctgtagtcccagctacttgggaggctgaggcaggagaatggcgtgaacccgggaggcagaggttgcagtgagccgagatcatgccactgcactccagcctgggtgacagagcaagactctgtttcaaaaaaaaaaaaaaaaaaaaaaaaaaaagaaaatgacttccattttatccaaaatttaggctcttaaaaatgtatcccttttcatgatattcttaatattaatgttctgtagatgttctatagaggcacttgaaataaactcaacatatctaataaagacagaaatggaaaggtaagtacataggttttctggttttgatgtactctatcccttgcctgttttttcttgaccaatacatacaatgttacttaaacatgccatcctcaatattcccaatgtcccctatactaagactagtcttgaccccagactgaaggaacttaaagttcccactaggaaatagtagggtgacataggaaagtaactcatccgaaaagattttctttagtggttcaacctatacaaacataccacccagggaatacagcaggcccagtgataattctagacatattcaacataatgatttccaatcaggtaggcaggaaatgaggaaaagctgttgagtgacagttaagtggcagggaaatatataattaaccaatcaatttaacaacaattagttaaaagcggtaccaacagctacttttattgagcccttactatgggccaggcactttatatacatcatctaacttaatattcaccaaaaaattcaggaaggcaatatttgtcaatattttgaattttattttttaaaccaatggagagtctgacagaaaatttgaacaagttgcaccaagtcctaaaactaacagatgttgctggaattggaaccaggaccatgtgctacagtaacttgctcaagtttctactaagctatgctccactctacgcaactctaagtttcatcaatacactggaactcatttcatatactcattccccttagtctattaccatgaaatacactaggttcaaacttgcaataagaaatcattaagggactcatcaccttacaattccaagtacagacaagtgtggaaatgatcctaccaaacaaggagaagtgtatcactgtcgcctttacatcttctcaggatgttaactttatctccagcttaatgacaagcacaaattcttgtagttcttaaatttcaggctgttctttagttttatagtacatatttaactgtatttatacccatgcctgagaaaatgctgtgtcttataaagtcatataatgctgaaggtcaaggaatatgctcttgccagatttgtagggatcctagcctagcaccactcacacgtaatcatttattaaaaattatttttctgatcatgatgctaatctgttcagagtcataggcccataaagacaatatttcctatgggttaagatgtgctaatctcattaactgaacaaaccagaatgaatttaatcacagcagtcaagggaagctaccgcatcattccaagacaaattagagatattgtacccctgtggtgttatctttgatttcgattagaggtttcaggctgcttcctatggctagattcaaaatattaagcctactaaagagaatgaaaggtaagtttatgactttgcatcttggaactgcactactgataactgcaaagcctaaggctttgaagagaaatgacaaaaaaaagtcaatcatattttcataaatattaagcttcccaattgtatataaatataaagaaaacatgcacattactttttaaaatgattcaggagataaactactggtataagtgatcatgttatcactaaatctcatgaaaaatatattaagctataacgattagcctgcttttaaaaatgtgtatgaaagtcagttattaaaagctagatgatgttgttaaataaagaaacttacaatgtgttgaaatttccctattggagaattataaaacaaataaaatagtgtttttctgatgcatcacataaaatgtagaagcgaaatttgagggtttagaatatttcaataaaatattaaatgcctgggcagtctccgtaattgtttcccttgagggggaaaaaaaaaaaaaaaaaaaaaacctttcctttcaggtagtaggcacacagttttactcaccccttgtctctccaaatctagactccaaatatatattagtcacaataaaactcacattcttattctgcttgactaatttgtagtcaagctgaatacaattcagtggaaactgaatatgaaataaattcatctaataaaaaggtaccaatgactgtataacaacatatgtagataaaagtgtatcatatataaaacattcaatcccacatggcagctttcctggaatataaaatcattttatcattatgggtattagctcatgaagtcagtattattttaaaaacatgctaagaatgttagcttcaaaatttaatatctcaaaagcaggattttggttataccaagtggtttataaaatagagatatttatccatacacagttttatgtgacaatttaggtgtccttatagcttcttggtgggcagtgtaaactggtaaaaaataataataataataattttgctaagtatttttgcgatacatataaagaccctttaaaaaatgttaatatcctggctgggcacggtggctcaagcctgtaatcccagcactttgggaggccgaggtgggaagattacaaggtcaggagatcgagaccatcctggcgaacacggtgaaaccccgtctctactaaaaatacaaaaagttagccaggcgtggtggcaggcgcctgtggtcccagctactcgggaggctgaggcaggagaatggcgtgaacccaggaggcgaagcttgcagtgagccgagatcgcgccactgcactccagcctgggcgacagagcaagactccgtctcaaaaaaaaaggtaatatcctttgacctaataatttcatgcgctggaagctgtctaaaaggaaacaaaatggtctactgggttatttagaacaacaaaaataaaaaactaaatgcctaactttagaataagtggtcattatgtgaacatttaaagtgtgtctataataacctaaaatcacttatgtgatagtaaaaaagggtgaaaagtcataaatatagcacgatcacatctaaataaatagcagaaaaccctcatttcgggtaaaaaggaacccaatgaaatatgccaaaatgataacaatgactttaagtgagaatatggttaattttgtttccttttacttcttccattcaattgggaatattaataattggacccttacagctgggcatggtggctcacacctgtaatcccagcactttgggaggctgaggcgggcagatcacgaggtcaggagatcgagaccatcctggctaacacggtgaaaccccgtctctactaaaaatacaaaaaattagccgggcgtgctgacaggagcctgtagtcccagctacttgggaggctgaggcaggagaatggtgtgaacccgggaggcggagcttgcagtgagccgagatcccatcactgcactccagcctggatgacagagcaagaatccatctcaaaaaaaataaataaataaaaagaaaattggacccttatctgttatatacaagaatcgactcaaaatggattaaagacttacaggtaaaacctgaaactaaaactactagaagaaaacatggactatgagaggtggctcatgcctgtaatcccagtactttgggaggttgaggcgggcagatcatgaggtcaggggtttgagaccagcctggcaaacatggcgaaaccccgtctctactaaaaatacaaaaattagccggtcgttgtggtgagcgcctgtagtcccagctactcaggaggctgaggcaggagaatcactggagcccggaaggtggaggttgctgtgagcctagaccgcaccattgcattccagcctgggtgacaaagcaagactgtctcaaaaaaaaaaaaaaaaaaaaaaaaaaaaaaacatcaactaaaagcttatgacattggtctgggcaaggattttttggatatgaacccaagagcataggcaacaaaaataaaaatagacaaatgaagttgcatcaacctaaacagcttctgcacagccaaggaaataatcccttttcaggtatatggtatacaaatattttctcctgctccatgagttgtcccttcactctgattaatatccaaaaatatataagaaaccttaaactcaatagcaatacaacaacccaattaaatatgggcaaaggacctcaacagactttttttttgaaataaaaaagcttttaaaatatgacaaagtaaaatcacagtggcaactgtgattaaggaactgaatttttattttttattttttttaagttctgggatacatgtgcagaacgtgcaggcttcttacataggtatacatgtgccatggtggtttgctgcatctatcaacccgtcatctaggttttaagtcctgtgtgcattaggtatttgtcctaatgctctccctccccttgctccctacgcccccacccccacaggctccggtctgtcatgttcccctccccgtgtccatgtctcaacgagcatgtcttaagggaaacaaatggacaacaggtatatgacaaaatgcttatcattagtcaggtaactgcaaattaaaacaatatgctatcaccccacacctgtcagaatggctattctcaaaaagacaaaggataactagtgttggtgagaatatggaaaagagggaaaccttggacccttaatgggaacataaataggtacagccattatggaaaacagcaggaagttcttcaaaaaaaaataaaaatagaactaccatacaatccagcaatctcactactgggtacatacctaaggaaatgacatcagtatatcaagtagatatctgcacacccgtgtttattgtggcagtattcacattagacaagatatggaatcaacctaagtaaccatcaacagatgaacggattcaaaaatgtggaatatacacacaatggaacactattcaactttaataagaaaatcctgtaattgggaacaatgtggttgaacctggaggattttggagttttcaaattctcaagtccaggcacggaaaattataatttttttttttggaaaaaaatgtgaaatatagacactattttctccgtctctgagcctagatactattttcctggactggatggagaatgtaaagtagaaacaagagtgtgttcctgagaggaggggatggtgaaagaaccgccaccacaacagagaaggttgggggtatccaggtgcagaagtaattgggtcccattccagagtccagcccaggaatgcaacaagactccaaagttatgtcagacccaggcaagaatcgtgagcatgtgtcttagcaaatggacatgagctagccacccagtacccaggcacttcagcaggatatagggtacagtagaataatttcccacatgcctccagcaaacacagtgctcaatgggtttttggaggatgaagaatgacaagggaaccaccatgtttcttgaccgtacagagatatgaaagggcctacaacttgaggccaaggaacaaggtccctatgggatgaattgtacatgaaatcaggtaagccacacccgccttcaaatcctggcactgtatcagtgtcaggactctgagctaagccatcatatcccctgtgacctgcccttatacatccagatggcctgaagcaactgaagatccacaaaagagtgaaaatagccttaactgatgacattccaccattgtgatttgtttctgccccaccctaactgatcaatgtactttgtaatctcccccacccttaagaaggttctttgtcattctccccacccttgagaatgtactttgtgagatccaccccctgctcgcaaaacatcgctcctaactccaccgcctatcccaaaacctgtaagaactaatgataatcccaccacccttggctgactcctttttcagactcagcccacctgcacccaggtgaaataaacagccttgttgctcacacaaagcctgtttggtggtctcttcactcggaggggcgtgacaatcaggtcccctccagaaatttaagacaaaaccccagagaaagggggggcatctcagtcctaaattggctgagatgaaatatgcaggatctaccggaaagtaggctttatatataaattaagttcagattcaagaaaaggcagttattgagattcactgccactgcatgtagatccttatgtggggatttctaagaatcattgtccagcacctaaactgcaaagcaaaccggtaataaatcagacaacaattaagagccaagtcatcttgagacaagagctcaggactcagagaagcagcctgcaaatgtgaaatggacattcagaagtcagtgagtttctgaactagcagtgcccggttacgaagctgttgaagagccttgtggactgctttatatgttctgggtagttccataggtcctcgcagaaagagaaaataaacctttcgttgaaattaaccttagacctagattcttaaaggactcaaacttttcgcggggaaggaaaggccagtctattgacaggagctgtagatattaaggcctgtggggggtgggggagggggactcattatctgggaaaagccacacccttaatccatcataaacagtgatgcctggggcacagttgagactacaccttggaggaagaatctaggtttttcctatccaactccaaaagaaacacatttcaatggcaactgctgaaaaacaagcaaacaaaaagtaccagcacctttttgtttctttggtaagaaggcgaaacatcccagattgtctaaaaaaaagaaattcgggaaatcagaacgttttatcatgatctggggttatgttgtccagtaagatagccactagttatatgtggctactgaacatttgaaatgggactagcataactgaggaagccaaattttcattttgctttatttttgcttcaattttatttatattgaaaacaaacagtttttaatattcttccattaaccataacttcattggtttgggagaacaagtttactttaacccatgaaaatatggcaactgaattcagatgtgctgtaaatgtaaaatatcctccaaccttaatgatttagtacattcttttcactaacgtaaaatgtctcattaagtcttttttgattacatgttgaaatattttagctaaataaaacattaatgtcacctgtttattttcactttttaaagtggctactcaaaaagtttaaattacatatatagcttatatttcttttggacagcactggcctggagtacagttcaaaaatagggcaaaaattcagagttacttcttccacatctgagttttgcgaacatttattcctgctacatacacaccagtctgtgtatctacacataatgaaaaacagacttttctcaatcccctcatatacagagggcaggtgagtgagccagtgagagaagactgagaggtaagtggatcatataaattaagatggcctaacaacattagaatcattaggatttaatcctataacttatgacaacagtccaagatgcaaagtgatttttaaaagtgatctaaattaaattttctagttttccttttctttccctttaataggtttcatgaaaatcaagaattataaggcggggaggtaaggctggagaagacaatctaataaagcgatgtaggacaaatgagaaaaatcaggcttccttattctactccaacactttccaactgtcatgaccttcatggtctgtctgtacctcaattctctgatcagtaaaatttggatgaaatatgctggactctgttgagacaaaatgaaaacataaggagagtctatcatctgtaaatcactacattatgtacccattagtattttattgttagcaaagattaatagaaaactgacaactccaaggctggatggcatgaagccctacacctagtagttgctgccatagtctgatttgaggttcctcaaatcattcttccccagcctaatcattttttctcttcagacctggaatcctgccatcctctcgcgtcatagtttgggggttactgcctgcatatgccaatgaacagtatagccacgtgacacagaaatgaaggccacagaaccataattcatcagttattcaatgtgttagctgacaacttggaaatcatagagcactcaactccaagttacttcctgaaaagcagagaaatgcttcctcagtgaggccacagaactcacagctttacattttacctacaatttgcacatgatccacatgatctggcctcggctttccctcaaccccttacaactgttacagtttcatagccttctgtcagtcactagacaaaactcagacacttccttccagtactggcaacattactgcacattcttcttttaggttttcagccctggctacacattagcatcacccgaggagcttttaaatctgtaccattgtgtgtttctgatgccccccacgccatgttgttttgtttgttttcgttttttgttttttgtttctttgagacagagttctactctttttgcccaggctggagcgcaacggtgcgatctcggctcactgcaacctctgcctcctgggttcaagcgattgtcatgcctcggcctcccaaatagctgggattacaggcacctgccaccacacccggctaatttttttttgtatttgtagtagagacggggtttcaccatgttggccaggatggtcttgatctcttagacctcgtgatccacccgcctcagcctcccgaagtgctgggattacaggcgtgagccacccggcctctaatgccccctttctttcataacattacacaccaagtattatttggcaaacttctcatcccctatactgtattacttattgacattgtttcccagctcaggcctacacgcttggcacattctgtctctctggccacaatgatcgtgtaagcaaggctgaaaaccaacttaaaggaatgggaagagttacaaacttaagtctcccacacatgatgcaggatgatgactttatcagatattttcatgattttatgatatttatcagacattttctcctgggaagtttatgttagagtaaaaatcatgtatcattagggagtagaggtaatgctaaaagcaaggactgagagtagttaattcatgagaatgaatgatggaatcccatgacgtgatagatcagctgctacactatggtctcaatagttcaattattcataaaattacactgatcgtagttttctaatgtgacatttttgttttgattattcggttggtcagacaactgagtaaccaaatggtttcgcctacttatttggttattcagttgttcagtttcttgacctttttaccccatgcttccttaacataagctgaatttatctctgttcaatgtaacacaaaagcccgtatttagagccagattataccagtttccagctgtgtcctcttaaacatattactcattctctcatgtcttccatttctttccttaaaaaatgagaataccacctatctcctatatatgtttgcaaacatgtttacaagatatatgtgaattaccttgcacagttagcatctctcaggatgtgaaagtgaccgtcttcctcctcagtaatttactctttgtcttatcaaagccattaaaacccctcagaggtgattaaatttgctgtgataaacagtggggttattaagcaaagtagtaaactatgaacacacctaagttttttcttaaatattgtagtggagctggaaatttttttttttaggtatttcttccatatccacaaaaaagcagcaagcccactgaaactcatctgtttgtgctactaaataatcccctacttttcctactgtaggttgatttattggtccccactttctcattcctacttaataggatggcatatctagcctatggtgggaaatgtgatagcctttggtcaacggggtgttaagaaaacatgacaggagcagagccttgagatgggctggcatgtttgggcttgctatctagtgacaacctatgaaaacatgcactgggtggccggtgccattccagtgtgtgcctctggacgtgacacatcaaagaaatccaaaccaaacctgccgctgaaagccaagcctagcaactaccagcctgatgcagaaccaaatctagatcaacttaggtcagccaaaccccgcatgaccatgagaattaatgctatttaaaaccattaagttggaggtaatgattattacttgatattattgttttgagagctgaccaatacatctgcccaaataaacgcgtttgttcacatcatgatgttgtactgaacccctataaccctcaatagcgaaggcatcaggttcaagagactgaggaagaaacccatagccagcaaacgaggcattgggttttattagaggtttacatacaggggagggaattcagtagtggtgggctggacaggagaagtgccttacctgtagaaacgatccagtggtggcagactggacaagatagcctcgcagcacagtggtagtgatggcggcggtgggatgagcgggcaaaccaacgctgcttgcgggcagcatgcagtttatatagcatttttacttaaccctctgcccttaatgacgttcacctggcaaccttcatccaacccaaaactcggggcctcaatccgctgtatgtatggcccgtgttccacgggatgcacttggggctcagatgttcctcatagacaaggaagggctctcttgctgggctactcccagattccgtagctcggaaaacacattcaggtgtgtctgcagtacagggtcattctaagggtatgcgcacattattgcaatcaggtgcatttaccatatacttgattacctatcttactggttatgttgttgttttgtgtgtacgtgtgtgtatgcatgggtgtttttacagagtcagatgtcaaccgcagggacaatacaagtgtcttactcatttcagcctgctgtaacaagataccatagactgggcagcttaaacaacagaaatttattttctcacagttctggaggctttaagtccgaggtcagtgttccagcgtgttcaagttctggagagggctctcctcctgatatgtaaacaacaaccttctcctgtgtcctcacatggcaaagcaagagcaagctctctggtgttttctttacacgggccaccggatcagagccccacctgcatgtgcttatcttaccctaattaattcccaaaggttccatctccaaatatcgtcccattgggggttagggcttcagcatatgaatttggggcaaacacgaatagtcagtccataacaacaagtgaaggactacagaatctattttatacagtaatattttcttttatgagctatatgaaagtgacaaagcaagtggtttagtattgtaataccatgacaaagattaagaactgaactgagcaaatactttatacttctggttcagttcatcataactgaattacccaaaaatataaaaggagagctgtagttgttctagaaaaatcttccttcgtgtaggagtgggtttgcgggttactgtgctaatccacacctggagttttgggcgtcaaggttgataagggtcaagggtttgggttttggctctggcttgtggaagatcgttttctgagagcattcttgggcaccagctggtcagacactcccattccaatgggacatagttttcaacagagaggaataatccaggtgtatataaggcaatacaagaaaccttgaggcttccaggccttagcaagaagaattggagtggaagtttaaaagcagaactggaacattttctaattgagggtggtagagagaattctgatatttatatattcggctgaggttgagagctttcaaggatgctgagctggctgctggcttggaatgaacgtgtgtgtgtgtgtgtgtgtgtgtgtgtgtgtagtgtagtgtaaataagcaacattgctagtcttgtaatcttataattgttcataagagaaaatacagtctagaggaagagatcatctagtttactgggaactagtaatgcttatcttgccgaggtttaaatgaatgatcacggctgtaatgacttataagaaaaattaaatctaagagcacagcctctgagcagaaactgtatacagaggtttatgtacacagctgtgcgatgaaaagaattagatgtgctgtgccctgatgcttttgcaataaagggttcaaaaatctgtggagaacaccctactccttagtacaacccagagcagtctgctgtagcctgcttaattggtatgctatgatcaaatccctcttgattacacccctagggtataataggaggcaggttttactttaacgcctttcatcatacagaaagtaaactgctttatggataaaaatagccatgtacagactcactattgacaccagccacccctggtgacttcaaggctcatcagcaatgcacaactgttttaaaataaagcaaagagtcacatgtagaattggaattacaggaataatgagaagtaaacagaaagaggccacgttgccttgagggctaacctatagattagaaaaaaatcggggccctaaaagacacactactgatggggtctagggatagagctatttttaaagcagtggtaacaaaacaattggtgtcacgtaacactccagtaactaagataattcacttgactgcaagacaagcaaaatataggatgttaaatgtgcaactatgtctcaaggttacccaagttaaaatttggagcaactaaacatgtctcattttacaatgacaaaatgaacacttagttttcactgtgtttaagaaaagtgtctttgccacattaaatgcattatcaggagatacattattatcacagctgcaaggaaaatatttttcagattcaaagattcaacaacactgtggtacgcagaacttgaattgctgtcagatgaaaagttaaacgtcagcaattgaaacaacaaatattcaggacaaagtgtttatagccctttcttttgagggttttcacattgaggaagtatgctttttatcttctccagtgatactttaacatgggccttcaagcacctgaataacagcaattacaaaaatatatttttttcatcaacgactgggcattttatgcgttttttttattttgcctattaaatatgcccttaaaatcgtgcttgttcctcagtctacttattagaagttcaaaacaaggctttggttcaaatccagtttctgagataaatttcttaattcattgtaaaaaatattaatggtgaccaaaattttaatgtttttagaaaacatcacaggtaatcagaacaaacaggaataaaaagaacaaagagtaaaggaaggagaaggaaggaagaaggaaaggggaaatataaggaggagtagagaatgaagaggtgaagggaaaagctgtgatttttattttcagataaagcacaggtagagaaaatctatgacattaggagagtctttcatttaaaaacctcatagttttaggtaggagggttcttattggtggaatctttcatacttgttcaatccaaattatccattaattgttctgtctgatttattagctttcatcaaataaatatcattttctatgctttagcaacttgaaatcatttgccaactgttgttatataatacaagtcgaaaaagttggtatgcccaaaggcttatctggattttgtattcattttttccattttgaagttcaaaacaagtcatttctttttctttattctctgcaatcaatacaaaatgtgtgttcatactattaagaagagcatgactgttaagaagccttagttcaatggattagtagacaaccatttttttaattagtcttccccctctgaacttttctccactttccgcagcaaatggaaacgtaatgagaatctcatagtattctgccaaaataaaggggatgtcaggcaataaagcatatccttgctaaatagcatcacaaatcccatatgtagaattatcattttatttttaagagttttttccaccaaaagccaagaataaaattgctttgaaggataattgttaaatggttatgctttggctctatatttgagcctccacgtaagtctttaattaataatttgtgctatggaccgtgttctgatgagatgttttgctaaggagatatgctcccttcccttactgccacccacaagagtaaataaaagcaagacactggcgttttggaagtcaaactgggattctgaagaagttcctgggctctgagtatcatgctacacagtagagagtcacttcctgcctctctaatatctaaaacaaaagatttgaactggtagccattgatctaattcaggcctgagatacatttggctagtttgatacaggacaggttaagccccaaaatcagggcttggcctgggaggattcttggctttgcctaggaaagaattcaagggcgagccagtggcgttaaacagctatgttttagtgaacattactgcgctttgtgaaatagggacaactcataggcagtgcctccaaagttggcagggtatgggctgctggctactgtatttatatccatttatacccactttcaattacatgtaaattaagtggcagattaatgcaaattgagagacaggttatttagaactttctaggaaaggggtggtaacttctgggttattgccatgtcctttgtaaactgtcatggtgctggtgggagtggcttctgctaatatgcaatgagggctgctggggatcacttttgttgccatctgctggtttctgctgtttttctcacttccgttggtcgctgcctgctggtacctgccagtttcttcactttatcctctgggaatgggaaataagtcctgcccaactcctacctcaggcttgcacagaatttttaattggaaaacctttttccagttacccaccaaatatacatcactgcctactatatatcaggcactgttccaagtgcttgggattcaccagtagacaacatgcacacataaaaaaaagtgctcaacttatgaggcaaatatatagtgcactgggatgttttacatacaactccagattcttaagttcctcttgaaaaataaaatatatggccaaaaatagctctacattctgacatggacactgctagactgaattgattagcagttgcccattttagactgggcacaggcgtgccatttgccagtattctttccaatttacacaatgtccgtatgcatttagatctttgcttcacctatttccattccctttcaggtccttgcaggtattttaattgtggactccattcactgtattattttattttatttcagttcagtttgtatcattttgagttcctgtttttaatttagtataatatcatagaaagtgtttgtacttaattctacggccgggtgcggtggctcacgcctgcaatcacagcactttgggaggctgaggcgggcggatcacgagatcaagagatcgagaccatcctgaccaacatggtgaaaccccgtcgctactaaaaatacaaaaattagctggtcgtggtggcacgtgcctgtagtcccagctactcaggaggctgaggcagaagaatcacttgaacctgggaggcagaggttgcagtgagccgagatcgcgtcactgcactccagcctggacaacagagcaagactccgtctcaaaaaaaaaaaaaaaagaaagaaaaagaaaaagaaagaaagaaaaagtgtttgtacttaattctaatgcagaatgttatggattcttatattggttctggtataaataagctaaataaatttaaacatgttttttaaactctgtgtggtccaaatatattctcagtaaagtaagagtttgacttatttgtgggtttgaaattgagttcagttgaaactcacaattcagttgagctgctgtaatttcagttttatggttccgtcttccttatgctatatatttttaaaagaggttttgttgataaaaaaaagaaagtttgtgaaccactgggctttctgatctctatgatctcctacaaatttaaacttatgtgatttaacactaatcaaaagcaaatcggtattcctatttaactttttatatacaaaggtcttatttccttaaaattccctaagttggaataatatcttaaaagctgttcttccatagtgtcaattaagtgcataataaactaaaaatatttgctgaaaatacatacacatctggtaaaattgtgttggtatgaataggaataataaatacaaaaatgaaaattgggaagagagaatagtggtgcatttgggaagggtggcatgtggaggagggcttctagagtattagtcatattctagtcaatttttctttaagagaagggccctcactctgtttcccaggctgaagtttagtggcactatcatagctctcagtctaaccttgaatttctgggctcaagccattcaactgcctcagcctcctgagtagctaggactataggtgcatgccactatgcccagataattttttaattttttcatagacttaatgtcttgatatgttggttaggctggactcaaactcctggacacaagcaatcctaccacctcagcctcccaaaactctgggattacaagcacaagccaccacacccagccccctatttcttaagtgaagtgattatgaggaatagctcaattcattattgctctatattccttacacatgtaaatcttatatgtacatctatagcaaatgaaaaaaaaggaattttcgttgatatttcctttaaatgaagatcacattggaggtcaaaatgtcacaccaaaaggaaagtaaaaaactcaaagtaaagatattttgttaaaattatgaagtgttaaaattgcaaatgacatctcatttgtaaatattgtattattatttattaagaattactcgaataagccaaaatgatgaaaatgcttgttatatagagaaatctaaaatgtaaggcagtaagcagctactcttccaataactccaaaagatgaaaatatgtttggtatactaaaaaaaatctaatctgtaatgtagtcagtggtatattttgaaagaaaagtaaaactatagttttgattatttataaaagaatgaattattttatatttaaaataattaagtcagagttaaatagtagtaacatgtaatttttaaaattgataggaagtgtatattatacaaatgtgataaacagcatttatactgtggaaaatttgtatcaatgacagaaggtaatctcccttcttactacaattcttttttaaagggaaaagaatataaaagatgaacaagtgtacagtctgaaaaggttaattttcttctttaaaaatttcaacactttgaaagtacctgcattcaacttctcttcaaaattattacttcttaaactacagtcagccaagcaatttgctattgagaactctcaaaatccattattaaatacaattttcaaacatacccagttttttgaaacacaaattttaactttgcttttgaaactgactgatgagaaattacctaactttgaaaaaatattcattaaaaagtccatattccacctagtcatgtgctaaatatcagcattataagcagctgtttcaaaacctagttttatgcaacatgtgccctttttaaaatttttcataaaatgtaatatctgttggtagcactactaataatattataggaaaacgctgaattacgatcatatagaaaattataaaatagaaaaataaacagagtttagtatagagtgtctgaacatgtgtaaagcaaggggtcagttgcggaggacgacttattgagatatttgtaatatcctttcatctacttttatctgttttatagtttcctagtaaattataagcagtgattacacccttaatctttggctttatggaaaagtataaaatcgctcttcagttttattatgactgtatatggatattctatttacaaaaacatatgctattacattttggccaatctttgtattaatttttgtaagaatatattgtgtaagtatttatagggtaataatacatatcatacgaatgttaagagtgcaatagcaaaataaagaaccatagccaaaataaattcctcataagcaagcatcacacacacacaaacacacacacacacacacacacacacacacacacacacgcagaaacatggacattttcttcactgactcagaaaaaattttcaggtaaaatgtcctgtaaatgttcgagtggtcacaagtaaaaatttacaaagtgtttctatagttccagcagaaagcgaggtgcattagaagaaaaatattcatgatatatttagaaagacaccaaattttgataaaacaagtggtaactcagtttaattaaccaaatatataccacatgcaaaatatgtcatagatactgataattcaaaataagtattctctaatttggaaattagcaacacacatttttgtgtatatatgtggacagatatattaatccatccctggcataggagtatcccaatgtactaatttgaactcttataaagcattcagttcaatataactcattaaatggccctacagcccaaagaagaagccatctttagtatgcatgatacaagctttcatttctataaaaagaaatggcaaaagattagatttgcaaagcaagataaaaagacacttgtcagctcctagatcttccaggaagcagcatatataggagaaagagaaaaaaggtaaaacatgattgatataggaaaacagctttacattataaattgtatggtgtctatatacgtgggaaattttctaaattaaaaacaagtcaagaaactataaagaaatttggccaggtgcggtggttcacacctgtaatcccagcactttgggaggccaaggcgggtggatcacccgaggtcaggagtttgagaccagcctggccaacatgatgaaaccccatctctactaaaaatacaaaaattagctgggcttggtggctcatgcctgtagtcccagctactcaggaggctgaggcaagagaatcccttgaacccgggaggcggaggttgcagcccaggttgcagcccagcctgggcgacagagtgagactcagtctcaaaaaaaaaaaaaaaaaaaaagaaactaaaaagaaattttcatttattatcagcaactaaaaggattaagtacaaagataatgtaactaagcatttagaggggaagactggtatgtgtaagggtatggtataaaaatcataactcttcagaagaaacaaagacttttgaataattgcaatgaaatgtatgtaggtagggtggggaaaaagtgggagaagaagggaattacagcagaggaggcgaggtagaggaaggcaaaaaccaaattacaaagggcattttgtgcaatgctgaggggtttatttttataataaaagctgtagggaaacgttaaagcattggtttccaagcctagctgagcattacagttacccagggagctttcttaaaatgctcactcccagtccctcatacccagagattctgatttaatttatcttgggtggagcctggtgattttcacatgtagctaaggttgctaacggctgtgttaatggattttaagtaaactacacaatcagatttatattgtggaatgaacactaatcctggcagtatttagactgattttggaatagactaaactgcactggatttcttatgatattatcattataatataggaaagaagacctgaagatctaaagtgaagccaggtagtaaggatggataaggagtgggagtggcattcatagttttaatgcgactggaacacgagaagcaagatatcatagtgattataaatattgactcgaattcaaactctactcctgccactttgttgttgtgtgaacttagacaagttacttaaccactctaagtctctttttgctcatatgtgaaatggaaataataatagctgcaccacagaaattttcaactgtcaaaccaggtaaggaagttaataatggataacaatatcaaagatatagcaaatattcaacaatggacagtcattatgaaaatctagctgtctcagtaaatgtgctggatgaataagagggaaaggtgtagcttggcttctagaatttatatgtaatcttttttcttaaaatataaaatatatagagaaaatctgtaagtcataagtgactcaataagttttcacaaatgtaatgcacccatttaaccagtatcagatcaagaagccgaacattatctaaacttcatacccctttcaagtcatgtctcctagggtatttatttggcccactaaatgtttagaaatagcaagagaaagattataagaagaggtgtagtagagaggaagataggtttaattttggataagtggggtcaagagcctgtgggatattcaaatggaaaattcaagaaggttttgagcagaataaagggtaagtcatagacactgaactgacagacattagcatcaaagcagtagttgacattaaaaatggttcttttcatattttcttttctttttttggagatggagtctcgctctgtcacccaggctggagtgcaatggcggatctctgctcactgcaacctccgcctcccgggctcaagcaattctcctgcctcagcctcccaagtagctgggattacaggcatccaccaccacacgcccggctaatttttgtatttttggtagagacagggtttcaccatgttggccaggctggtcttgaactcctgacctcaggtaatccacctgccttggccttccaaagtgctgggattacaggcatgagccactgcactcagcccataatgttttaatggtgtatgattcaagtgactaggcataatatgttgcttgtctcgttgctcaaaaagtaagaaaaataaaagaaagagactccactcttttgctaggtttaacattgtgttgttgtatgtatatatgtatttctgtacacatccctatattgggaccatatgaccttccacaaagaaacaatcttacttaaaattgttttaaataaatatgtaaaaagtactataaaattttacattattttgcgacagaaatacaagttttgttactgattagagatgcagcaacagtttgcttttcaactacattaggaaccctatgagcattttttagataatttcatagtaataagtaggaagtacataagacataggattcactaacttggtgagaacttaattgctcacaagagaaaaatgctagactaatccccttagcaaagaatctatgattaaaagattctaaaaaataatttgaacaatttccagttaccataaaaagacatggttgagaaaaatgcaactttttgctattgatattcaataaatgtttactatatatataagttggggctgagtctttctttcattctttgggtcttagcataaacaccacctcccccaacaccacctgctctaaattaggtttcactggccactctcttgtccccttgtccatgagagcacccaacataatttgaaagtatacatttaattgtttgttagccagcttattgactatcttctccttaatggattagtttgtgaaagtttagaccatattcatttggttcactgtcatattcctggcacctagaagggttgttgacgtattgcagagattctcaatcttggtgctactgagattttgcacaagatgattctttattatggtgggttgacctgaacattattacatgtttagcaacatccctggtctctacccactagacaccagtagcaaacatctcttcttttagttatgccactaggaatctctccggacatggtgaaataacccctggacggcaaaaccacccagagttgagaatcactgaataatttaatacataaatgaacaaatgagtgagtgaatgaatgaatgagttaatgaataactgtctgattgctcagaaaacggaagtagaagcaggagcaaagcacattccagtcagatagtgatatggtttaaattcatgtccccacgaaatctcatgttgaattgtaatccctaatgttagaggtggggcctggtggcaggtgattggatcacggtgtttctcattaatggtgtagcaccatccccttgatgctgttctcgcgatagtgggctctcacgagatctggttgtttaaaagtgtgcagcacctccccacttgctgtctctcttgcccttgctcccaccgtctgagtcacctcgctccccgtctgccttctgccatgattagaagcttcctgaggccgccccagaagcagaagctgctatgcttcctgaacagcctgcagaaccgtgaaccaactaaacgtcttttctttataaattatccagtgtcaggtatttctttacagcaatgccagaatggactaatacagagggaacagtaaataagtagacaccgagggacttgaaagcttattacatgcaagaactaagacagagctagcttgcctggagctacaagagcaaagctgaattgaaatgggcgagggaggcatggtccagttatgtaggtcaaggttaaaaggtttggaatttactcttggtagaatgagaggcgttttaatgaagaggtgagatgatttaattgatctttctaaaaggttgctccaaatgctgaaattaggatttatagatggggtcaagactacatgagagagagcagttaggatgctatttcagtactccaggaaggagctgatggtacacagaagtgtcaaagttgagagggactgtactaatttgtaggccaagccaaatcaatcggccaagcaaaatggattctatataaatattatgatcatgaacaatatattagaatgacattatatgcataagacataggtttggttattttacatacatgtagatgaaattaaagaactaatttcctgaaagattttaaaaatcacttagtctctgtatttgttgaatgactatgatatcatccaaattccagaataaaaacattctatagtgtaaattcatgagaaaataccctattgagtattattggccttataatgcaagcttcacttaactttacaattgtggaataattttctcactgtgatgttcatttcattgcgtgaaacaggttcagtacattattcatgaaactacttcaaaatgctttgttttagatttaaaaaatattggtattcacataactgctttgccaatgtgaggtttcatacgaaattcattgtttgattttctgaaaacttatcatattgattttgtgtcaaatctttatgaacaagcatttttataataaagttttattcttttctcataatctccttcccttcatatctcactatagattgtactaaatattgtatctatccttcatgtacatacagttctacgaggaaataagaaattcaagcggttcattgaattaatcactaataggagagaattgatcaaaatttgctgtaattttcttccttcaaaatcatcagaattctggtaaagctttgtatttcataatttggactccacatattggtgacaattcagacactgagagtggaacacaaaggaattgggtaacgagatcactaagggaatttttagcctagtaaagacagtttctcaacattcaagaataattcaattacataaaaattcatataatagtaattaaatgacaaaatacttttgaatacttattaatgcacacccctcagagacctgaaatttgcaagactatatagcttaatttgaatttgaattttcttacttattttagcaaaataaacttaaggttcataagaacatagctcttcattcacttatcttggtcgtaaatactgttaaacacaaaatcaggtgcccacagctcacaaatctacacatgacacatctctttacgttcctcctgacctacctcagcccaaatccctctctacctcatagaatttgatattaactttctgctaactttttgaaaggagaatagttctgttgctacgagtcacccttgaccctttgcaagaccaaacatgccgataatttaaaatgtgatgtaggctctaatcaataattaagtgttgttctattaacttatgatatatcacatactttatttgattcagtgacattaatatcatcatcaaacggtattataatttctcatattttaatctcctgttctaccatgcagcagagcacagctgcatattatattttccatgggaaatatcagccatcatatggcttgtagtcttccaaatttctggcctacttttcaaaatcaaatgtctacaatttccaaaaaacactgaaaatatttttaaagtacattttgcaccaaacattttaacttatgagtaatcaacctttacaacatttgaacgtaaaacggaagtgctaaaagtctggcagcaaaaacaacctttcagcattttatgagagatcctgtatcgtcatattggtgaatttaaaatgattttaagttctttctttcttctcatgagactttagatctaagcagtctgtctttagcactaaccgggatcacttcaatgcaacattttcatggaacacagcatttgctgtcaatcaataagattataattacaaaataatgatgccttacagacccattctaaaaatactttgacatctgaatctatgaaagggctcaaataccaaaaaggatcttccagattcacatgaataaagttcctgaggtagttgatattttaaaaattccgtgtcatgccaattatgtgaacctatgctggttagatcacacctgaaaatttaggatgtattgtcatggtatgtgaactgactacaaaaggtatcaggaggttgatatttgctacataagagaaagatgtgttcaagaaatcctcacacctttgcatctcactaggcaaatgggttaattacatctgaaatcatatttcgatttggttgatagtctgataagttaatttaaggtgaccctggtaccatctaactgttttgtttttattccaaataggatattggccctttctaaaaaggattatgtagtcttgtctatatgagcaaaaaaaaaaaaaaaaaaaaaaagtaacctgagtataactatggtactaagaaagaaaatcagtatacacaggtaggatttatctgccataaagaatagttcactgctataagaatttcttacaagaaactctactggataatcaaccttctagtcaaactccagggaattcaatgtagtttaaactcaatacatattagggaaatcacaaaatgaatcatatgtagtcattctatggatgagttcacaatctagatagtatttccgtgggggtaatgaggagtatctcgccacgtcagaggagtgagtatccttctgccttcttaagtataacacatatagttaacataatattttcttgaagtaacagtagagagtcaagccttgtaggagaacagatattttctaccaagtctcagcttagtctgttactcagttttcttgccatagtactctgcaacatgctgaatccacggtttttgtagaaatgcgtccacaaaatttatgccatgaatgcaacaaaaaagcagtacacacatccagtaagaaattgaattcaatcagtagataagcttggccaaatatttgaaactcaaaaactaaatcattaattgtgcaaaagtaaagaaaaagtgggaaacgaaattaatgtaaaatattccaaaacattcttactatttttaactaagaaagcatattttactgatgtctgcaagccttttgttcttcactctttcaattctctaatcctgccatccaccccatatctttctttcatttggaattttggtttacaacactcagttgtagactcaggcatataacttgtgttttagtcttattcctttgcacaaagacaaaatacatagacaggacacattgatcagaaaaccagaaataatctatttctaaaatttctaatccctgacataaatgtatcaaaatcacacaataatttaatagaatgagaattgcacacacacacacgcggcacaataaaacccaaggtaaaccaaagcacaacaaatgtccttctgaacaaaaaggttttccagacagctgagagctactcctttggatgacagaacacctcaacttctggatgaaaggtttacatgaaaatgattatgtaggacagctctctttcccttcttatgtatggtatgtctaacataatattttcttgatgatttagggttagaattatgatgtgaagatatgactgtggaaggattgatcccaggtacatgtggatgttcacccctagaatgcaatttctttttcttttattttttttagatagagtctcacactgtcacccgggctggagtgcaatggtgtgatctgggctcactgcaacctccgcctcccaattctcctgccaagcgattctcctgcctcagcctcctgagtagctgggattccaggtgcccgccgccatgcctggctaatttttctgtgtgtgcatttttagtagagacggggtttcactatgttggccaggctggtctcgaaatcctgacctcgtgatccgcctgcctcggccccccaaagtgctgggattacaggagtgagccaccgcgccccgccctagaacacactttcttagaaagtttcaaaatatctttttactgttacagtattttaggaatctgaacacttattagtaaaaggaaatatgaacttgctttctctcaagtagtatctttctttctccacaaagccatgtcttagagctctttcaattatgggtattaaaccagtatgaccagaatctcagacaacagacactatcctgtccacacagagctaatgtttatccctgtctgcagtcttcatcaacagtttggaaaggaaaagtcaccctcgctatttcaatattttaagctgacacattttacgaattcctttacactctaaaagtggtctatatatttattagataggacttctcaaggcatgatatagcctagaattttctggaacctctgaatcctttattgacactgaaggtccatgatagtgcctgcaaaatgattgaacaatactaaatcttgtaaacaatttcacattatatttgtaatgtaccacagtcattgatcttatgaatgatggtgaaactggcggtgggaaagagaggtaaacacaaaaatgtgtatcctaacactaaaccagtttcaaaaggctgtgctcccaagttatcctagccataacatgttctgatttcttactttcacattaaactctgtatagtatattgtagaacttaattcatatctgctaaattaaatgagtgaatacataaaacggaaaactgaggtaaattgtgtactacttacactaaatcaaagtacagccttaaaggaatatacatttaataatgagttttattaaataaaaataatgtattctaaacaattgtctgcatttaaaacttgccaatggaaccatgaaaaaatgcccaaactcatttttcattaatgcaattcaaagtaaatccacagctagaaacaattttatactcaacagagtagccaaaagttaagtttgacattgtcaagtgttagaatttgggagcaagcagaatttttaagttcgtgagaatttaaattggtgtaaccaattttaaaaataatttggcataatcttggaaacttagaaatacatcatgtcagtcagaatctaagcagacacaaaaagtcatttgatatttaaatcagaaagcttaaattatagaattgaaacaaatgagagaagaacagagttgacaagctgtggaggacaaagtgactcagagtttagcaaccacaggaagccactattacccttaaagtacagggagaggaagggagaggagagaagaagagtgggagagaaggggagagagagagagagagagagagagagaaggaggaggatggggaggaggaagaggagaaggaatggggaggaggaggaaagaagaaggcagggtgcatgaattcagtgaatgaggttatgagatcattcattggaagctgcagctatagtgggcctatctggttggaggggggacatcaaagcatatgcagctgttgccaaagatactgcctgaaacacaaagagaggaagagaagcactcttgtgtcttccctgagtttccaatccttcaccatcagccaaagagagctggaagtcacctggaaatggaagcctggcacacacagtctacaaaggtcagtctcccagtggtacacagtagagcagtgtaaaggagccaaagagtataccagagggcacatacatgggccctgtgacccagcaatcccactcctacatgtatacaaggaaccttgtttgtaataggaaaagaattaaaactggaaacgaccctagtatccatcaacagtagtatgcataaataaattgtgggttatttctatgacggaatatgacataatgctgcagtcacagacatggatgaatcttagcaacataatgctgattgaaagaaacagtcacagaagaataaatgcaatatgattccaactatacgaagttcaaaagcatgcagagcaagactatttctcttttagtaatacatatatatgtagcaagactataaaacaaagcaaatttcacgaccaccgttatctctggtggtagtggggaagcgatggaattggagatgggtacatagatggcttcaagttactgtggaaaattcgaagtaataaacacatttggttatgattgaaactgtatgtcttaaaatcttttgttcttatgtaataagatatttttaaaagacagatacatgtttaactgattggcaagttagtataacaacatcaacctaaaagaaattaagtttatttttgtttttgtttttgttttttaaatctgaaaagcatttccctttcagcttgctgggtttcttgcactaaaagatgagggtttaataatcatagcagatcagaggcttcagtagggaggagatgggatagcttattgtgaaaaacgattttccccctagtttaaaagtggcccctggtaacatttttcttgaagcttctagttatatatatcgttgtcagtcactttgcaactttgaagaaacagttttcctgccgaagggctctattatagttaatatgtgtctacataatacaaaaagtcatttaaaaattattgctttaagaactatttattgagtgcctcctaagtacataacatcaaactgtgaatttaaagtggacttgcataatttaatcaaaatttatactaaggaaaacaggctatagggcttttcgatactacaatacctgaaaaatgaaatactacagttataatccacatgataccaggtatgaaacattcagtagcagtgggctagagctacaggttaccttcttgagacacgttgtcaaagaagaccatagcactaggtaattgggaaatccagttggaactgtgtagcagacactgcccactctgttggtttacctctggcttgatcagccctgtaatggagagtctcgggcatgctaacagcccaccaggtcaagcacccactgcttctctgtgtttcagcctcacgactttgtccaaagttatagaaactcactcatccaacacacaggaggggacctgatgtccctgagaaataattaatgaggcacaggaaccagagacatattccccagcctcttattcttcagagggacaattatgagtacattctacagcattcctcagaggggtcttcacaggattgaacaacagtttcccactgcagtagccagctgaataatacactcactattgttttcccccgtttttccttacttcccctgcctcccacttgtgctccctgtgatcagctaccaaatgagctagttgctctctagtcctcgcctcaggcttagcttttaaagaaatccaaactaagacaaactgtgacaaattacaatccaaacgagattctttcctctcagggggatgcttagtccccccatcaagcatcattatcaaaatgaacacagactgcagaggaagaaaatatttgccttcactgagcaaagtcagactcatgaccctcaggttagagacacagagaaatgcaactaactctggggtgaataggtacagattcagagtggaaagactttaaaacagcaataaagtcctagaaataaaaaaagctgtcagctcggtacagaccagagcttgagagcaagagtactaagcgactcatagaaaaggattcaggagggaccagcacagcgactttaggctcatagtaacaagcaacagtttgctttggctaaagtttattactaggtgtggacaagcaagagataaatatcggaatctgtgggtacagcctttggatttcatgccatggcaaggtaaaatccatctgcaacatcaaaaacagagaggcatttgcaaaaggaaacatgaggagaatgttcctagcagcactgcccaaaataacacaataaacgaaaaatcttcgagcagcccaaatgccctctggcaggaaaatggacagttaacctgattacatagtagtcaaagaaacgactgctacacaaaacaatcaagataaattctagggatgggatgatgcatgaggaaaatatgagtcccaaatatctttttaataacatttaaatataaaaacaaactaaaacattttgtgtcatacagtaaatatttttaatgttctcacatatgttcacaatagccctatgacatatttactattattgtccccattttttttttggatgagaaaactgaggctcagagaacttcagtaacattcccaaggtcagatatccagtaattagtgtagacagaattcaaatccaggtggaaatgctctgaaacccacagtcttacctgctacactaaactggaacaaatattgttgaaacatatgtatctgataaaacatttaaaaatattacaggattataaattcaggcaatgtttactatcccaaagttggggggacatgggaagatggcatgaggaagctgtgctttatgtcattgccaactttctagtccttcagttggtggttaagtggagataaggatgaggccagagaacatgagtggcacgaatgcaagattacatcttgtattctcttaaaattttaatattttgctcatatgaattattttgcattgattttaattgttaaaatgaggtaaaatataatttatcctgatttctgaatttttaggcgaccgcttacattttgtgattcagacatagccatcttttctgggagaggaaggggaggaggtacacacaggatttgtcttgaatgtaggtttccctattttcagagattgtatatttgcttcctgtggcttggtgtgaggtctgatgaatgttaagcgaaggctaaatcaccccctctctccttagtaccaccactgaagtcacttctttctggccttaagttcaaaaggggaaactgaatgatgagtattgagcatctacactgtgtcatggcattagtaattgttcctcacttgactccctcagtagctacataaagtaagtcttcttattctcatttcatggagtaagtattcttattcccattatgtggaagaataatacttaaagtattcttattcatgtattaaaaactgaggctcagaaatactaagaacattgtctaagggcaaatatttcaagtgccataaattcttaaacttcatgggtattttgtatgatttttcttttcaacctcttttgactgggctattctgggaggtggtcacagctattagggccaaatgaattaaaatatatgaaaatgattgatgaactgtaaggcatcatatcaacataaatatagtataattaataatgtcaataataaaatcatttacttctacttctagtattcagaagagaggtaaaggtatattttgcctattttagagtaccatatgaaatgaaataaaatattattatgaagaaaaatttactcttttcacattgggaaactatccatcagagtcaacaatcattgtcctccttctctccaaaatagaacatgctgaggtttatgctatatttttgaactatttctattaacacaattaaaatgctgaaatgaatttgaaaagatgtttatattctgacgaagggtaactagaaatattttctactctaaattgagtcaggtgtgatactgtaaacaggataagtaaaaatataatataaaatttcaaaatttactacttgattccaatgtccagaaaagaatgaaaatataaatcatataaaactctagccaatttaagcaactgtaatccctttagacatcattaaatttactttacctctgacagtaggtgataccataaatgagtaagaacatattttaaatgtcaatatattgtctctctggataatatatttgatggttttatataccttactaaaacccatagaaactttttaaagatgtgatattagtgttgatatctattgaagatataattggctaaagtttaaaaaagagtaaaatatttttttccaagcacagcccagtaatattggacatgtgatctttgttttttactgttgtcataagcatatagaaagacaatttagcaagtgttctgatgaggtttaaagagcattttttctagtatatggtagtataataaacaataattcattgtatatttcaaaatagctagaagagaataattataatgatcccatcacaaagaaaggaaggattgagatgatggatatcccaattactctgatttgatcatttatacagtatatacatgattaaaatattacatgtgatatactttggctctgtgtccccacccaaatctaatgccaaatagtaatctccttgtgtcaggggagggacctggtgggagatgactggatcatgggagcagatttccctcagacttttcttgtgatagtgagtgagttctcacgagatctgatggtttaaaagtgtggcacttcccccccccccacatcccccagctcctgccaccatgtaagatgtgccttgcctccccttcaccttctgccaagattgtcagcgtcctgaggcctccccagtcatgtggaactttgagtcaattaaacctcttttctttataaatcacccagtctcaggtagttctttatagctgtgtaaaaatgaactaatacaacatgtaacacgaaaatatgtacaactatgatatatcaaaagctacaaactatttttgtttgctcatttactatatatcttagatattttggaaccaccaccaccacacatcacacacaaattcacaaacataacatgttataaaacataggaaatcaaatgagaacatttcctaaggctatgctttttcaactggtagttggggaggaaactgaatttcaaaatctccgctctataatttctctctaactctatattgtcacttctggggaaaaaaagagaagaaggtaaattgcatcttctggctctattcagaagaagaaaaaatggttggtgatctttgttgtatggattttatctgatgggtctcctagtttacacttagatttgctgaataaatcctcctcatttccagaaagacaatatggctttgtgggagtgctgaaggcacatctttgtcagttcccactatcggagactcccagtacatcctgtcatgccaggatttgctctgcctgacaagaaggaagaagcttatgatagctttctgaatgactctgaaaaatgaagctgctctgcaggtatcatcactagaccacagataaactcaataacattcatctgctagaaaaaaaaaaaaaaagaaagaaaagggttcacttccagatcagcctttggtagagataggcagtagggacttggcagtccctagtcacattcaaatgaaggttcgacctattgtgctgaagtctaagacaaaggtgcttatttagatttcctattttatggctaaaatatatgtgactgtaggaatcctctgttggacatacgcatacacaccaacttatctattgcaagggtctatattattagtatgactgtatattaaataattttattatctgaaaaatttgagtgcattgaagataaaactgactcctgaaatctaagtcctatttaatcaaaacttgcttcaaaaccttcccaaagtttcaacatgtattattttttcgtgtgtgtgacaaggtcgcactctgtcgcccagatggtgcagtggtgtgatctcagttcactgcaacctctgcctcccgcctcaagtgaaacctcccacctcagcctcccaagtagctggaattacaggtgcccaccaccacacacagctaatttttgtgggttttgcagagatgaggtttcaccatgttgtccaggctggtctcgaactcctgggctcaagcgatctgcctgccttggcctcccaaagtgctggcattacaggcatgagccactgcacccggtcaacatgtattcttaaacagatttaaaatgctttcttcatagcattaaaaatgtttcacaataatttacatgagaactctatggaagcttaatatatttccagcataggatacacacaatgattcaatgtcctggcccttgaagtacacataattggaatgaggagaaggacatttggaaaataattaccatgcaatatgatacctgctattgtacaggttcttacaggtgctacagaagaatcaaaggaaagggagactaattccacctcagagaattaatgaaatgtatcacggcaaagatcagattttgtctgggtcccaaaggacgttcaaaagcttggtaggttgagaaagtgggaaacagcattccaggtctaaggagactgccttaaagtttaagtaggacagtcaaagagtggaggaaataagtcaaaataggaaaatgacaaaaaatagagaaccttgtaggccaggcttaggacttctaacttaagacaatggagatcatcaaagaccctttagatgactaagtctgagagcagtgtgtaaaaggattggcttgaaaagatcaaaatcaggaagtccagatagaattgagaagactatggcaaatagtgttggttgatgaaaaggcattgttggtattaatgggagattccagagatactatccaacctgttttatacttttttgatcaggttgcatgtctaagaacatccctaggaagtattacttttcactgcattattttttactattcaactataaagtaaatggatgcatgtaactgttgagcctttccttgcactcatgccataaatgtaagaacataaagctacaccttaaagttaccttttagctcttttattttttatgttttagtagtattcagtctattctactgaattcagtcccgatttgttatattttatttactcttcaaagaaagtttttcaaatgacaattgaaataaaagaagataccatttgttctgtagattatctacattccaattcctatttcctaggttccctattctaatcatctacttttctatattttcttcatcaccaaatacaggcagtcacaggcaagtgcaggagttaataatcattgataaattacatgttatatagactttgatattcaatttctctggagatatataactatatatacccttctttccctcagagggctttaaggaaactaaatccccaaaactaaaagcactgactcatggtttaaagggtaagttaaatctctctgtaaaggaaagcctaaatgtgatctttgcaaacataactggtgatcaatagccgaaagattaaagcagtacatatgcaaaaaggaagattgaaacttaacattttgtttattgatgtcattcttagatctcaattaatttaatttgatacatcaacctccgtcctcaatcaaacactagatggataaagataatcactattatgtaatagtcaatacgcccaggtgtctcctggcatatatgatctattgaaatacatatattattatattttaactaagaaacacagtatctaacccaagtattatgtacattttttaaacaattcacttccttgaaagttatgagttaccaatcatttttaataaatttctcccagctttacatttatctatcaattatatctgaacttcaaatacactctggatgcatttgtctcagagcaatgatggtgtctaagcttgcagtttctgtgtctgtgaaattcatttgcagtaaattgtgaataaataaatgcagtaaaaagcctaggctccttggagagtctacattctcctccctcccatctctttctctcttcttctctcctaccctctcatcctccatctgtccctttccctatccttcttatcacacatgggaaaaactcaattgaattaaattcagtctaccagaagtatacaattgaatttttgataaacacaccagaaattagatgtgtatgttcatttattccttccgcacatatttgttgaatgtttacttcatgccacactatggatcaagcagtgaagataaaacagtaaacaagacatgcaaggaaactactctcatggaacttccaatctattgtagggaatagcaaataaatgacaaaataacataatcacccaatataataagtgttattgaagaaataaacaagatgttcagatagaaagtacctaaaatagagagtccagggaaggagagagaactagtctggatttcatagtcaaagaaggtgtttttttggatgtgcaattaaacagatttgaaggatgaaaattattccatcatgcaaaataatagcacaagtttgtccaggaaagagcctttgcaaattccctgggatggaatagaggccttcattactgtttggaacttctctcttcaatctacctttgtagcctaaaaggcatttttaaatatggtcaagaatgttgaaactgtttttcttgatagtgtaaataaatgtatgaactactcaaacaattagctatagtgataaatcgaataagttggtaggtttgaatatgctggataacactgtttctgataccacctagagactggttcccatctgtcaactggttataaaacaattttggaaggaatattataacttgcaaagaaaacgaacagaattcagagaaaaagtaacaaaaattgctcttaaatatttgaaaatatgttcatcctcattcctgagtagataagtgcaaactaaaagacatagtttcatagtttttcaccaatcatattggcaaagatcaaaagtttggtagtatactgcgttttttatggtatgaggaaattgatgttctcataccttcctgacagatttgaactgatatacgtggccatgtgtatgactatgcgcatgtatgtacagcagatatctgaaagaatacacagaaaaccgcaatgccagcacccccagtaagagagaaggaggataactaggaggctagctaacataataggagaaacaattttctttatgcgttcttttttgtttacctctatgaattttgtactatgtgcaattaactaggtaattggagctttaagagcactttgggggtcattaacactaaaaatattttacatagaaataattataagcatattcatccaaccatttatttatttatccatgcacccatccatccattcatccatccatccgtttatctcttcatccatctcatgtttaatttgtataaacgtttatttatcccatagactctatgtatgtatggtacatgtaaggttatataagagatacaatgttaaataaggcagtttctactatccctaaatttacaatgaaggagaaaagctacctcatgattacagatatgaagggtttggtaaatgcatcaccaaggcttacacataagcagaaggagagggtgcagagagctaaaaggctcccccaaaggactgaaacttgaaaggaattctgcagataggtttgaaagccctgacatgatttttttttttttttactgtttcctattgcatattcttttgtccctttcaagtatgaaaattcttataatttccttcaatgtatactctctaagtaataaaaacaattgtattctcaaaagctaacaaacaagaaagcaagcaaacaaaagttcaggtatcacatttgcagtaatatacaagtgctttcattaaaattatgcttttatgtgtttacttagaggagtcttgagaaaatatttagacctaccccctaagctttagggaagtggtccccaacctttttagcaccagggactggtttcgtggaagacaattttttcacagacttgggctggggagatggtttgggaatgattcaagcacattacaacatttatcattaaattctcataaggagcacacaacctagatccctcgcatgcgcaggtcacaatagggttctcgctcctatgagaatgtaatgctgctgcttatctgacaggaggcagagctcaggcttgcccggggctcacttcctgctgttccccctggtttctaacaggtcacggaccgattggtctggggcccagggtttggggacccctgctttggggacccctgctttggggagaacagcataaaaaggcagcatttctgaaactgttctagatttttatttttctgtcagtaaaatggttgtagtattggtatataaatcttacactgtattgtagagtctcaataaagttactcactgaatgaatattttaaaaagttttcccttattaaattacaaaagtaaaataggagtactataacataatctacataaataccaaatatgaattgatatatttttcctatattttaacagaaattcttcttgagagaaacatagaattctatgtctcctatttatagacattaactgctacattttgcacaaccacttttaccgttagaaagagaactgtactttgatggttacatagcaccttttcctcatgtacaaaatactaatgctactaacaaaaataattttaagtgatcaaaatatgaaatgtaattatcaaaccccattatgaggatgaggttaagataaagtaaaatcatctttgtcagggtggggcgcagtggctcacacctgtaatctcaatactttgggaggccaaggcagggggatcacttgaggccaggagttcgagaccagcctggccattatagcgaaaccccatctctactaaaaatacaaaaattagatgggtgtggtggcacacccctgtaatcccagctactcggtaggctgaggtgggagaatcgcttaaccccgggagccagaggttgcagtgagccaagatcgcaccacttcactccagcctgggcaacagaagtgagatcttaaaaaaaaaacaaaaacaaaaacaaaaaatcaactttatctatgctttgctataggtgttaacgataattgcctattgtcctacatggatgattttattaatagtgattacataaaaaaatgaaaaactttctgtgtagtggtgatgtaaaaagatagttttcatcacatggatttgttatatttttaaaaagataattcttcataggtttttcagggattgtctggttttatttgtttaatgaaaaataaatgaggtaacgtctcattgtaaaataagagtttaaattttaattaggaaaagatacccaagacagaaatacatttaaaataagatagattatcacttttaattatagaaaatgaagctttccagaattatgtttaaatttatagatgcattaaaaactatcaagtttaaacatttaagtacctgaataatgttgagcaaatagcaactttggactatgctggcatgaggagagtgaggaaatgccacgataaaaatcagaaattattaaagaagtccttgctttcttttgcttacaaaagattctattgatattgaaaaacaaaccaaaacaaacaaaaaaatggctacggcatctggattcaaaatgtttccataagtctatggatgcaaagtgagtctcaattttatgaaataagaaaaaagaaaaatgttagctagaccaggcatgatggatcacacttgtaatcccagcactttgggaggctgaggcgggaggattgcttgaggccaggagttctagaccagcttgggaaacatagcaagaccctgtctccacgaaaaataaaaagaaaattagcagggcgtggtgtgcacttgtcccagctactcaggaggtgcaggtgggagaatcatctgagcccaggaattcaaggttagagtgagctatgatcatgccactgcacttcagcctgggtgccagagagagatcttgtcccttaaagataaaaataaaaaataaatattagctaacctactagttttacctgagttccttcagtggattacaacatatttcaaaccacagccctattgaagttaatttctgtgtgatggaatttattagctttatgttttaaaatacactgattttctcctctgaaagagtgagaaaatattctttagaaacagtttacattacaaactctgatgagtggatatgaatactttgccaatgaaatgtgtgtggatacttggaaattggctgggacatgaataaattgctcaaccctattactgtacacactgaagtactattttttagtacttcagcagtaggtcagcagtagaatcctcatatccccaaagaaagaacattataaatatatgtgtaaatttttagcataaaacgtgtttaaaataaaatattaagatggaatattaagtataacctgaatattaagaacagatacactcggaattagtggggttggggaaaaagtagaagacagctctgtggccgatggttttggtaataatgtttagggattccaggaatatgattttcaatgtcatagtatttttccaaatgactaagtaggtttttcaaaaactctgggtttttttttttttttttttttttttttttagaaaaataattgatggactcaatctgaaagttattttggcctaccatacaaagcctatgcagttctcagtatgtgacctgctggaatgagtgtgaccacctcagtagatactaacgttgtactggcaatacttttaagtttaaaaccacaacattgtattccggaagacttctattttgagtcttttcattctgatagtatcctccaaggaactttaaagaatagaacccctgattcaggtaacaagatctgaatgtttgggatgcatcagtgagtagaagcaattcacgcactttcagaagtccttaacttttgggcccctcaagtaactggactgtaacttgaatccagtaaatgaactacatgaaactgtcaccaaactaaagcaattgatgaaacagtaacacgaataaatataaaaggcactgctaaaaaggctttaagaaaggctttttaacatttttgagggaaatagtatgtaaaagtgtagtacatgataactaaaattagttaaattaattgcaggagttactttaatcaccacatgtctacataacaatctaaactactaaacgttataatcttcaagaaaaggctacaactatgaaaaagagcattggtgaatgtattaagtttgatagtaaaaacaaaacagacaaattaagctgatttggccattgattaacttttggatattgggggacataaatatttatggcttgttttctatatctttaaattgagtatggatccagcaatcccattactgagtatgtatcccaaagaaatgaaatcattatattgaaaagatatgtgcactcccgtgttcattgcagcattgttcacaatagccaaggtatggattcaacctaaatgtccatcaacaaatgaatggataatgaaaatgtggtcacacacacacacaatggaatataattcagacatgaaagaagaaaatctaccatttgtgacaacatggataatcctggaggaagttttgctaagtgcaataagccaggcacagaaagccaaataacatatgatctcgcttattataggtggtatctaaaaagttgggctcatagaagtagagagtagaatagtggttaccagagactgggaggagggtgtgaggcttgcagagatattgatcaaagaatacaaaatttcatttagacaggagaaataagttcgagagatctattgtacatgttgattctacaggtggttcataacaatgtattatactcttgaaaattgctaagagagtagattttaagtgtttttcacttggctgggtgcagtggctcacgcctgtaatcccagtactttgggaggcggaagcgggcggattgcctgagctcaggagttcctgaccagcctgggcaacatagtgaaaccccgtctctactaaaacacacaaaaaattagcaggatgtggcggcgtgaggctgtagtcccagctactcaggaggctgaggcaggagaatcgcttgaacctgtgaggcagaagttgcagtgaaccgagatcaagccactgcactcctgcctgggagacggagcaagactccatctccaaaaaaaaaaaaaaaaagtgttcttcctacaaaaaaataagcatgtgaggtaataaatatgttaattagcttgactgagccattcatatatatatattcaaaacaacatgttgaatgaaataaagataaacaattttttctatccattaaaattaactatttaatttaaataaaataaaatggatttgatcatcctaacacatttactaggttgttataagatctaaacatggcatcatctgcagaggtcttggcttaatgtctgacatatattaattgcttagcaaatcgtagctgtaatcactaaataaataaatttattgacttttttattccatagtacccttcgctacattatttgtatctctacttcgtctactgggaaggtatgcctgtggcagaaaagtttccatcttatctagcctttctcacattcccttctgtccaaatcattccagcccactctgaatctaacttgttttgacagagtacttatttacttggcacatgataggttcttaataaatatttgtttattgccttataggaagaaagttatgaaggaaatataacttgtttactgaggggtagcaagtttccttctttctttcttttttttttttttttttttttttgatggaatttcactcttgttgcccaggctggagtatgatggccagatctcagctcaccacaacctccgccttttagtggagatgatgtttctccatgttggtcaggctggtcttgaactcccggcctcaggtgacccgctgcctcggacgcccggccgcaagtctttcttttatcttactaaacacagacaaatgatggagaaaaagtctgttaagcaaatgcatactgtcttggattatttaagttttcgggtatttaggttgatttcccaactaggatatcctggaaacagatttaatgtaaatcatcttatcccttcaatctttagattctgtattaatctttctaaaaatttgctcttatgttcttctggaacatttatatccctaatagggatggtaaatctgataatctgatattcaaggtagcatggtgcacacacggattatttgatttagaaaaaaaatagacatgtgtttccctaaccgcttgtaaaatgcagcatgtatataaatcatctcatgtattaggcagtttccattttcccaaaagaaaatatgcctgtgagccctcaaaaatattttaggccaacatgtatacacaaaattttaggactttagcaaatatatataatcaattgtatgcatgattttgataagaaattgatgccattaattttctatgataaaaatattaaatatttttatatttcatatttatatcatataaaacattagaaatattagaaatgctggcatgttttttagtctcgcatttcatgaaatgactttattcgatctctttgaaagctactttgaggtaatttttttctttgtcataagaacccctttttttaatgtcatctagaagcttttttcagaacccatcaactccatttccagctacataagttgagataaattactttgtgaatatgtatgctcttcgtcataaaaatttgacctcacgccacactctgcttgctagtaagaaagctgttgtttatatttttccccttgtcttttggtgtatatttgtgaattcaatagcatgactgcttactgttttgtatatgtggatacgtaggtatgtgtgattttttaaattatcattaacaatgacacctagcaagtaagaagatgaagtcagatacctgggaataatctaacattcaatatttgccttcagtttttcaatccgtttcatcaggtaacctacttacagatgtaaaacttgcaatgatttgtcttctaaacagtattatcttattcagagtaaagcaattgagagttctttctaaaataagagatttttaaaatataattaagcaactttgaacaaattcacctataaggagacgtaccagttataacactgttaacttacatggggttggggtaattgcttacaatcagatattctcagacattacaaactttaggttgcagtactacaaacaaatataatgaaaacggtgaataaacatttgtttatgcatggctttattcttttgttcaccaattccttgttctgtttaaacacattccaaaaacatttacccataacgtaaaggaaggtatgcatagatataatttcaaacattagtcaatagcattcagtgactgaatggatttcgggatggagaaaggaatacaaaaataagcgacttcagggatttcagatataggagcctggaagcagtggtgcttaatagaaaggggaaagagtcatgaagagctggtttatgtgggagtagataatgagttccatttggtatatttaattttgagactgatggggggacacttaattggagacgttctgtaggtgtaattatattaagaaggggaaaaattcaattagagctccaccaaattatatcagctgtgtccaaaccatattgattgcctgtgtgtatagctggtgtgcagtgtagcagagctgaatgctactaagctcccttccgttctacgttttttgatttgaagaagaatatggagggtgacatgctggaaagaggacatgaccagcagctttctctctctctctctctctcactgttcctctggtttctcctttgtttcctctactgcaaatggataatactgtgccatgttcaactaattggccatagttactgaggatatcaaaacccatcaagcacagatacttttcttttatattattattatattttaagttctgggatacatgtgcagaacgtgcaggtttgttacataggtatgcacgtgctatggtggactgctgcacccatcaacccgtcatctacattaggtatttctcctaatgctatccctccctttgccccccaccccctgacaggcccaggtgtgtgatgttcccttccctgtgtccatgtgttcttgttgttcaactcccacttataagacagaacatgtggtatttggttttctgttcctgttttagtttgctgagaatgatggtttccagcttcatccatgtccctgcaaaggacataaactcataattttttatggctgcacagtattccatggtgtatatgtgccacattttctttatccagtctatctttgatgggcatttcaacttacaatgaagttacatgctgatatacccatcatagtttggaaattttgaaacttgaaaatgcatttgatacacctaacagactgtacatcataggttagcctagcctatcttaaacatgcttagaacacttacgttagcctacagttgggaaaaaaatcataaaacacaaagcctattttataataaaatgttgaatatttcatgtaatttattaaatactatactgaaagtcaaaaccagaatagttgtataggtcctcaaagtatggtttccacagcatgagtatcactttcgcaccatcctaaagtcgaaaaattgttaagttgaactactgtatgtcggggaccatctctgtacttgaaagtagtcagaaaaccaaaaaagtaataaaaatatatgatacggtattattattattattattaggtctagtattctacttagagaaagaggaacttccactaagtatctggattaaaagaagcttttgttatttatacaactaaaacgttgtagaaattatttcccaactaatcaagacgcttttaaatgccttcacaatctaatcataacctgcttttctagccctatttttggtatttcacccaagcattcaagatttcagaaacatatagctacccattgtccttcccagatactatgaaattacattcctttaagcttttgtacatgttggtccctccctcctggaatgcaacccctactcctccataaccccaattcttcatttgataaatctttacatgctttgagatttatctcaaatattaccccattcctcctaccctaagcaaaaccattcatttcttttgcattatatatatttactattgcatacacaaaatgctacattctctatgacacactatactaggttgtgaactcatcaagtgcactattttttaatttttccattctttacacctaactcaagtctatgcatatatttttctattatatgattcatatattatatattatacatttattatatatattattttatactatattaatacatattaacaattaatactatatatatttcatatatgttaaattatgcattttatcttattacatattatatatattcatatgattcatatattatatggattcatataggtttgttaaattaacagtgaaagccccagtttttgaggaaattgtatgtattgcctatatcttggcagtcaactttactaataagctgctataaaataaatatgattcattaagagtgtaaatggaatcctaataaggagataaccctaaatttacgatagtcaggcatgttgtgcaacagagaaactgtattctgtaattgctagggggagagtgcgtggttactgtcgatagttgcgttatttagatcattacattgcataagtaatgtatgcccatattgatgtaaacgttatgcaggtaatgcatatttattacaaataaattagaaaatagagtaactgtgttattctgatttgctgaatcttttgttcacatgtaggctgaggtataaatcaacagaataaaagtgtttttatggctaaggtcagtgagagattcaaacaaacgtataagcatataagtgtgcttatataagtatgtattcatagtcacacacatatactcacatgctaacgtatcaattgatttaaagttaattttatagggggttgatttgtcacattatcaaacactaaagaatgtatgagtttttaaaatgtccatgagtgaagaccaaatgccagctaactgagtgtaacatagaatataggtatattgaaagtattcatatcaacttatatttcatcataaagctgtatttcattttaaggtttgaaactccaatatctactgtgtcaaagcagattgagtatataaaggaaatgggttcagtggtagctatgacaaattaaattttgcctgcttctgtaaagtggaaagtccctattcagaaccagacaattgttactagaactaaaatgagggtctagaaaatctattcaaatatacacacacgcattatgctaaacacaaacgtatctgtccttatcaagtaaaaataatgagcaaacatctgtgcatgaatgtaagctcagtctactttatcagggctatttccgattttggctgatagatcagtttccttattgatatggctacaatagaatccatttgaatgagattttgtaaccataaggaattgtattttgtaaggtggggtcacaaatcctttcctgtttcaaactgattaacactgatactgctcttttgtgaaaattgcctgtgtgcaggaccatatttgaaaatttgaacaataaataataagcatatgtaataaaagtaatagcgatgtgtgtcatattatatatagtttccgtactcccctagtggggtgggtggattttattttcaggggaacttccaaccttataaacaattcaccaatacattttccatctatggggtaaaaatgcaataggttatagccatatagtttacgccagacctctaaggcatttggaataaaggtagaaaaaaagggcaacatttaatatttgaataaatatcataagggtgaagaaaggagagtcgtgggtacatattgagagaaaagtaattataaattggtatgactagaagagaatggcaatgagctttggcaaatgatccccattatagtgtagtttaaacgattgatgtacaagcccgaaaaggctggagaatatcagatctgctggttacagggtgtatctgactaccagtttcagggtacagctgaaataaatcagtgatcccagaaaagaagtttctttttacgtgcaaaacttctgagcaaagtgatctctgccagctggagctggggattcacagcctctatttttccatcaaaagaattaagttgactcccagatagagaataactatatattttttttcagatgtagcctcctgagtactcaaaaccatctccaggatatggaaaattcaccttatccaaacgtatatggctaaaattcctttgtaaggcactacctatttccctgtttcttgtatttgattagagataactattgagaaaacatggtttatgaaagaaatgggaaaatattttcccgttttgataagaatgtatttttaaaaaacaaatggaaacctaaagacacaaaaaaatatttgtaaaggggataataccctgagggaagggagccagaagtagagactagagatattaagaaaaactttaatgaatttatattttggctcagagctcacctactaagggagtaaacaggcaaagtcacaaaggtttataatccttacacttgccattggtcggggtaggtgattagatgtgaaaaaaaatgatgctttatttattctgggcatattaaactgaactgggtgatttaaatgaactgtaggaaattcaatgcaacagctaaaatgaatgactaaggagctagaagatcttaatctgtataaagctgaaagaacaaaatatgcacaatttagctctgtgctaatgaaaggaaagagataacactaaaaataactgaatggtgcaggcttcaaggcagcagaagagttctggcacaaatggatctatccagaaaaaaatgagacttaattacacaaaggaaaaactgttgactgtgaggaaaagtgtcccaagatgaaatgactgctgttgaatgggaaaccatcagagaggcagtgacgagagtgttatctcgacaactgaagcagctgaaatgagacacgttgccggaaaagccattacagactaaataccccctggtcctaaagagatagatgcacatcaacttaaggagaattgcagagcaggcacaccactagaacacggggcagtgagtcaggagtagggtctttatctcaatgccattaggtgtagtcttgctcaacctaatttatttctgcggcttggattgctttctgactattctgcttcagtggaatgtcgttgtgaccaattttgttgctactaaaatacttaagtaacaaaatccacttcttgataaagatttaatgtcatctaatccctaagagttaaggacattacaaagattatcagtgaatcaatgaatattggtagtcatcatcaaaaaacaataggttgagagtttcagtaaaactaatgaaaaccatatataagaacattataaatatgattacaatagatgcatctcttttagaaacaaggtaataaacactgtgcttccaagatgtatttaagaatgttgaaggaagtgaggcacactgacttgtgcctataatccccctgggaggctgaggtgggagggttacctgaggccaggagttagagatcagcctgggcaacaaagagagaccatatctttaaaagaattttgttttagttagccaggtgaagtggcacccacctgtaatcccagctattcaggaggattgcttgaacctaggggttcaagcctgggtgacagagaaataccgcatctctaaaaacaattttaaatttaaaaatagaaaaaagcatgctacactgggccccaagatctatgcttgcctccaatttttccccaatttttatgatttccctttgtgtaatgtgatatttgatgcataaaagaatatatgtaatggatatgtaaattacaaagctcaataataaaacaaacatatgtccatcccaataactgaaatattagcaacaactcacacctgaacctatgtgctcctacactagttcttcactcttttgtacccctccctccatttacccaggattaactaccatccagaatctggggattgtcatatcattgcctttgatttcttttgtttgctcatttgttttgtgttggttttttcgatttatcacacatgcatgtatgccaaaacaatattttcattaggtgttcctatgcttgagctttctggagtgttgtctaatacaagggtcagcacactaccgcccatgggctccccggctctggagtgagtgcacttccccaggctggagcgcagtggcgcgatctcggctcactgcaagctccgcctcccgggttcacgccattctcctgcctcagcctcccgagtagctgggactacaggcgcccgccaccacgccccgctaatttcttgtatttttagtagagacggggtttcaccgtgttagccaggatggtctcgatctgctgacctcatgatccgcccatctcggcctcccaaagtgctgggattacaggcgtgagccaccgcgcccggcctccctgacagtttttaaaaatgaagttttattagactcactcacacctattcactcatataataactatggctgctttgatgccacaacaacatagttaggtatttgcaatatgacctagaagcctgaaatatgtactatctggccctttaagaaaatgtttgtggacctctacattatgtttttatgattttctcatattcttacatgtgatcatagttaattatttatactgctatataatattccatggtatgaccataatacaattatttgctattatgaacactgtagctacgaatgtccttccctccctctctggcactggagacactcagtgtaaattgatttcctaaattaattctttaatcctttttgcgctgaatatagaagtcacaaagtcacacaaacattaaagaatatttggaaataagagtagagtacagaaaatgcaaggaaaaaaaaacaattctatctctcccccttagacaaccggtaatactaatgttatgcctttttcctcttgctgtgaaactccttatccattaacagctaaggaaggatcactgtcgcctcaccttcctttttcatcctgcctattatgaataatccataaatctcattttaatgatttcactagaaagcattaaatgtaaataatccgtgggggtggacataggaggtaatattagacgagcaaaaggaagaggcaagatttaaaagaccttattaagcttttaaaatgttttagcacatgtattctgttcttaatatttcacacacacaaaaaaaactgtctagaaaccacaggtgatttcataactttacttgtatctcttttttttttttctggagacggagttttgctcttgttgcccaggctggagtgcaatggcgccatctcagctcaccacaacctccgcctcctgggttcaagagattctcctgcctcagactccggagtagctggggttacaggcatgcaccaccacgcctggctaattttgtatttttagtagagatgggctttttccactttggtcaggctggtctcgaactcctgacctcaggtgatctgcctgcctcggcctcccaaagtgttgggatttacaggcgtgagccaccgcgcccagcttacttgtatctcttaatcccatcataaaggggcatatcctattactttaaaagccaacaattccctctcattttcattcaccatgagttactactactcctgaaaccttcacaaagtttcccagaaacaggacagcccactcctagcccatgggcctcttcccttcctcatttcttacccttttcttcctccctgctttttttcttgaaataaaatttccccaaaagctagtctgccactgcaagcacatcctcagataactggataaaggaagataatgtggcacagaggagtctggggatacttctagccaaatagtttttgtgccataataatctttatgacagtaggatcctgaaatgttacctagaacacttgtgcctagtcccaatttctggtgggataaaactgtatataagggaatcattacaggtgcttgcgtctgagacacttctggctatgattgagtctcctacacattatcaaaaaacgtgtaatgctttaataacaaaagtaaatgaaaatcctcaaaggagttaatatgctaatgtacatagtcactttataagagggtagtgtaagcaaattatcccacattaactcaatcagagtcccggtagaaactggaggattgatttctcaatctcggggtatgtgaggccagtttgctaaaggggttatcaacagagatatgctcagtgttaggaaattcaagaagggatgacggagagttaactgtagacctcaagggttaagaggaaggacgtttcctgaactagagagccagacccaatagaaatgcaagagagaactgtccagcagaagctctggtctaatgttagctgttcagagctaacctgtggaaatcccatggggccacatgaaaataaatactccacccttttcttatccactgtactcctcctgctgcagcctgtctcaactggaaactgtagggcaaaggaactctgatgccattcctaaagggcagtccccaggacacaaagcacagtggtaaagaatgaaaaatggatttgaaaggacaagagggaaagaatttatgcactaagcataacttttccctttcaagttaatctagtatgttgagttggtttgctctttaactaaacccccctgtttccaaagcctgaggataacatactacctactgagttggtaaacaaccttaaggcagcagtcctggagcctagacagagacattggatgagtagacgaatggaggtacacgaggtatacatggatggatgcatggatggataggtgaatggatggatgaagtcaatcacattagtattttacagacacacgttacacaacctgtatctgaacacgatgagtctctcttcctcctttgattatggaagttaagagcaagcactgaggtaaccaatattatatagatttctggagtaaaacaggtactcatcatgactatcaacgatttgaatttggggatgatgtcaattattcaaagaacctgaaaaaagtagtgaagttgcttatctgaggccccagaacttccttcattttactctggctttcaacgttggatacacattaaaattatctaggaaacttttcaaactgagatgctcggattacagaccacttaagtcagactctgtggaaatagaacgcagatatcactgtttgtaaacactccaccaatgtgtagcaaaatgcgaaaactactgatctttccactctctttaagatctaccattatgagccccaaaatcattctggttctcttggtaatttacattttttaaaggaaactctaagatgccttgctgataatattatatatgaaaagggttatcgaatttatcgggtttggggttgggggaaataatacttatcaaaggagtaaaaatatgagcagttcataaaataacctgtgatagtccagattacttgcatattttcccttgcatttcagagtccttatcagtattcaaaggactgtagagcttttagaaatgcttcagtgaggaacactttatactctgtccctgataaatgaaagtgtttatttcctctcagataagtcagtaacaagcaagtattttctagcaactggactatacccacctattcatttcccaaggctcattgggcatcactaggaatacaacaggttttagttactaccaaccccagttactgtagaattaggcaattatataagagtttaaaaaatcagtaaggatgtttttattttaaactacttggataattgaaaagtaggtagacaacatttattttttgtctttatttgccaaacgactgtattagatttaaaaccagaaaacaagcccctatgtagaatatagattctcaccagttcatagatcaagtaataagacatttcctagggtgtttaattgtttgatactaagagcaataaattataggaaaataatttgtaataattggttaagtaattaaccacaattaagaaaagatgatggaatccctgaggatatccgacaatactgacaacattataaactttaagagaaaaaaaatagttgttgcagagcaagaaaagtcatcatgtgcctagcacaaatagaggtctaattataggggattttacgtttttcataatgtctacaatgagcatatactacatttataatcacgaacagtccattagcaggtatcatatatctgagttgggaaataccctgtcacttcgctaatacttctttctttttgttctaatagtgtattcaccaaataatcttctaaatatatatgtgtatatatatatatttgagatatatatgtatatatatttgagatatatatgtatatatatgtgtatatacgtgtatatatatatttgagatatatatatgcaggaagaagtgagtgacattctaagaaacactaatgaccaaaaaaccacataatatcttttcttagtggtgttccttccttatattggccaaccaccttgcaataaaaaatgatgatgtagacagaaaggaaaagttagagctacctattctttttcctttccttttagtccctccttacacgtcagtaagccaaagggcatcttcttgataaactgtacatttatgaagaaaggaaataaaaaccattaagttcattttatgcagcatttccactattctggtaagtaaagaaagcatgtgtgtggatgatgtatgaaatacaaattgtgtaatttctatgactctccatataagttaaatattctcatatatccatctaaaaatagcactgacttcagtaaagtttcaggaaacaaaatcaatatacaaaaatcagtaacatttctacataccagtaattttcaagctaagcaccaaatcaagtatgcaatcccatttataatagccataaaaaataaaagaggtgaatgatctctatgagaagacttacagaacactactaaaataaatcacagatgacacaaacaaatagaaaaactttccatactcatggattagaagaatcaatatcattaaaatggccatactacccaaagcaatctacgaattaaatgttattcctatcaaaccactaacatcatttttcacagaactggaaaaaagctatactaaaattcatatagaaccaaaaaggagcccaaaagtaatcctaaggaaaaagaacaaagccagaggcagcacattacccaacttcaaactatactataaggctacagcaaccgaatcagcatggtataacgtttcagttacatacaatgaataagttctggagatctaatgcacagcatagggactatagtcagtaatactgtattgtatacttgaaatttgctgagagtaaattgtaagttttcttaccacagacacaaaataactatgtgaagagatggatatgttaattagcttaactgtagtaatcagttcactgcgtatatgcacatcaaaacatcccattatacatcttaaatataggcaatttttataacatttaaataagagcaaaaacaaaaacaaaaacagcatggtactggcacaaaaacagacacataaaccaatggaacaaagtagagaacccagaaataaagccacacacctgcagccatatgattttcaacaaagttgacaaaaataagcaatgggaaaggactccctgttcaataaatggactggctagccatatgtggaagaatgaaactggatccctaattttcgacatgtataaaaattaacccaagatgattaaagatttaaatgtaagacctcaaactagaagaattgtagaagaaaacctaagaaacatcattctggacattggggttaggaaagcatttatgactaaatcctcaaaagcaattggagcaaaaccaaaaaattgacaagcgagacctaattaaactaaaaagcttctgcacagcaaaagaaactatcaacagagtaacagacaacctacggaacaggagaaaatcattacaaactacatatcacacaaaggttcaatatctagaatttacaaggaacttaaaaaactgaacaagcaaaatacaacgccatcaaaaaacaggcaaagggcatgaacagacacctctcaaaagaagacatacaagtagcctacaagcatatgaaaaaatgctgaataacattaattgtcagagaaatgcaaatcaaaaccacaatgagataccatcgcacaccagtcagaaaggccattattaaaaactcaaaaaacaacaaatgctggtgaagccgcagagaaaagggaatgcttatacactgttggtgggaatgtaaattagttcagccactgtggaaggcagtttggagatttcccaaagaatttaagacagaactaccattcaatccagcaatcccattactgaatatatatccaaaataaataaaattgttttaacataaagacacatgcattcacgtgttcatcacagcactattcacaatagcaaagacatggaattaacctagatacacatcattggtggactggataaagaaaatctaaatataccccatggaatactatgcagccataaaacagaatgaaatcatgtccttcgtagcaacacagatgcagctgtgatggaggccattatcctaggcgaattcatgcagcaacggaacgccaaataccacatgttctcacttgtaagtgggagctatatattgggtactcatggacataaaggtgaaaacgatagacactagggattactagaaggggaaggagggagggggataagggttgaaaaactgactattgggtactatactcagtacctgggtgacaggatcattcgtaccccaaacccctggaattcacttgcatgctccctcccataaggagttgaaaactggtctaggtaaatgaggcaaccctgtcacgagtcccgggaaggggtcagggaaataggctgcttcgatatcatacaactctctttttaaaaggtccttccaatatttcttccaacttgaagtccagctttacaacaagtttctggactctcttctttcctactctgcaggttatcagaaaataaaacaaacaaaaccgcaaactacaaaataacaaaaacacccaagcaatgtgattagttaagacattattaaagtgtgggtgtttccagagacgtttcccctttacaaaccatcctattctcttaccttttgagaagggagtgtgtgcgtgtctacgtgtacataagagagacagagaaagtgaaagagagggagatttggtagataaagactcaatagacttaggaatttcctatgtcgttatttgaatttgagagattactgagtgtaagaaaagataatccattttggctggagcagtggctcatgcctgtaatcccagcaatttgggaggccgaggcgggtggatcacctgaggtcaggagtttgagaccagcctggccaacatggtgaaaccccatctctactaaaaatacaaaaattagccaggtgtggcggtgtgtgcctataatcccagctagttgggaggctgaggcagaagaatcgcttcaatccaggaggcagaggctgcagtgagccgagatggcaccactgcactccagcctgggtgacagagtgagactctgtctcaaaaaacaaaaaaagaaaaaaaaagagaatccattttaacttgaatcttgaaattttctgtaaagtagcagaggtaaattgccatggaaatcataggaaaggaaatataagcccaacacggtaatagactctgcaatgaaatatatttatggtgctataataatagtgtacatactgtttatatgttttcaatttttagaataaatctttgacaaaacacgagacctaatcatagttagagaacacagaaggaatgcaactcaacataaaattaaaagtagactttacagaatttgggagaagaaattcagtaggagaagtgaagaaacatggaggaccactaaaatccccattttatcatgtgaagggttaagacatacttttgacactgttttgaagaaaaaaattaacatttaaggtcttcatgtaaaagaaaaattagttaatagaacaaatacatggggtagatataaatgagataatttttcatctctcataagagagactgtagaccatgaaaaaatgagaaaatcaagaattagagatataaacatgttattacagatttgtcacgcattagaaaaagagaatgactcaaatatctgcctctgaggagtgagaaatgagagaggaatgcagcatatttaaataaaagaacttatgaagtaaaaattacttgaatcatgtacagataatttgattaaaaattgaaaacattgattcaaacaaatttatattcattaataagcattgtacactttttaaaattccaataagaaaaaatgagagacttaaaattaggtaggaatgcatttcccagaggttaaaaatttatattttaatatatatgcatatataagcgggatcataatacagcattatatgtatacatactgtgtattacagtctgctttattttttcatgtatgtatttggattacctttaatatcaatgcaatcacctgtaaaattttattttaaatttcccttctttagagatatatcattttttagtagcctcctactgatgaatactggtgttgtttccatttttcactgtaataacaattaaacaataaatataggtacaactcagtctttgcacatagatgtaagcatttcttcgataatttccctggaaatgcaattgcttagtcaagtgtaagcacgctttctcttgattggtattgcaaactgctctcatgaaataaattgattcagtcttctgtcagaagcatacaaagtatacaaggaaaagttatttttattttcattatttggttacaaatgagatcgaacattttttcatatacctttggatgtgttttattttctttttgtccaaatatatggggtacatgtgtaattttgttacatgcatagattgtgtagtggtcaagttagggcttttagagcgtccctcacccaaatatatcatacacattaatttctcattatccactccactccaaccccctcaccctactaagtttccattgtctatcattccactctctgtgtacatgtgtacacattttttagcacacaattatgggtgaacatgcaatatttgactttctgtgtctggttcatttcacttaaaataatgacctccaggtctaacactttcttcctgtatgcttaaaattaggcaatgcatttatttttctgaattgatttgtaagattcaatttcagtttactggtttttaatgtacagattttaaaaattatctatgtgttttccattttaaattttgggtttttaaaatcatttctacatagttctctaccatcgcctcattgtagaaatattcacctatcgttcttcctgttctttgggcttcttaagcttaattatgattgaatatttgttcaaggtgaaatttaattcactgcattgtgtaaagcagggttttgccttttaacatgattatcaaaaccatttctttcatagtccatctctatccactgatttgaaattccatttttattatatacacttgagcatattttgggattttctcttttgtttcactaatctgtttgtatagacttttagtagattttttttttttttttatacagagtcttgctctgttgcccaggctggagtgcagtggcgaaatctcagctcactgcaacctctgcctccctggatcaagcgattctcctgccgcagcctcccgagtagctgggattacaggcgcctgccatcatgcccggctaatttttgtatttttaagtagaggctgggtttcacgatgttggttaggctggtctcgaactcctgacctcaggtgatccacccgcctcggcctcgcaaagtgctgggattacaggcgtgagacaccgcacccagccagtagaagttttattaaacactctaatagctacatgggcaaatgacctttcatttaaggttttcaacattttctattaatcctcatctatattgctgccagataaactttagagtaattcttgtcacatccaatgtcttcctgccaccccaatttaaattttatgtgtttctatcagattttagcttaatttgtagtaaattatatgtctaaaatattaatattcccaccaagaaatataaaattatatctgtccatggatgcaaatattctgttatttttccagtaaaggcttgtatatcaccaaatttcatgctaaataaattcacagtaatttcacattttgaacttctgtggaaaatgatagctttgattttcaataggttgttaaaagagaaattagcatttagaaaaattacatttaattaatatttaattatttctaggttttttcttttcttaatgagctttgggactaatttttcccattagttataatagttgtcattgttgatttacttagtaccaagttgacaatatcatctattaatatgaataatttgacttttttccccaatacttatacttcctgtttcttttacttggcttctttcactgactagaatatgcaaaatagcatttaaaaagagcagttttggtagtcattctagttatatttctaattttaatgaggataccttcaatatttcaacattgatcacagagttggctcttgttttgagatagacaatatttttcatgcttataaactatcatctattcttacattgctaaaagttttgtttctactcctaaattagggacagattcttttcatttatcaatactttttcataactaaaaagtattgtatattttttccttctgatctttacctacaatgaaggatgtaaatagattctcttatagtaggcatatatgttttcctgaaataaatccaatttggcatgataacttcttctcttattggctaaatctgctatgttttataagatttgaacgtctgtattcctgagattggttgatagttttcaatgtgtatgctatttttttgaagtctcataatcaagattataagggctttagaacatgaacatagaggtttaaatactattttcatggtttggaattttgtaaacagataattcatacttagttgtttgaaagcatttctcaatatagtatttttgaagttatttcttgtactgctttttaaaggtttcttacagaatcaaatgtttagttctcttattttccctttaatctcaaatataaaaaaattaaggctattaattttctttgattacagctttgttcttattccagaagttttcatgtgtattttccttattcattaatttttaaatggcctactttttttttggttcaaggaaagaacactactttttctctcctgttacaaaaacaatgtatgtttaccataaaaagatacaacaataactattaagaaaagtacagataactcattttttcattaagcagcaccactgctaacatcctgttgtctactctgagtgtttttctgtatatctgtctataaaaatctaacgtaaattcaatgtccgattcctgtattatctaaaaattatatcatatgatctactaatcatcttttcctatttgttttaaattgcttgctggttttgttacattacatttttttctagacattttataacaaaacagatatatcaaattaatcatattcaatgatgtgttgttgcaaacatatgtttatgaagtccctgcttcgttgacattttttttcttgttcatatggctggattttctttgaatttacgggcttttgtatgggagctgctatattgtttacaagttcaatggcttgcaacctttcctgtgcattatagtcacctggggagcttttaaacagcccagtgactaggttgccacctaaaccaattaaattagaaacttcccaggtgggacctaggcatctgtaagttttaaagactctcgtgatgttctaaatatcagcaaaggcagaggaccattgagcttgttagaatatttgggaaagggtgtttctaagattaaaacttaaggcttatgtatttcgtaaacgcagctgctttaacaaattagtaaacaagctaatcctagtatctctaaaaaacactagtttaattttgcctggagctgcagttctcaatatattgtccagcatatcctccatgcagggaaaccactgtatacaccaatacttatgagggaggatgatttttcaactgcaaatctttaattgccttttagaaaatccatccagttttccttaagcaagttttagaaagcacatacacgagcaattacaaatctggccttcagcctaactcaagaattaaaaaaataaaatctcaaagtgaagttgtattaattctttttttctccttacttttatttcataaaaatagacatctttatcataaaactggcttcttgacatcatttggggccactttccctctgaaagacaattctaattgcatttacttgttctcagaatcatacatttttttaaaaatgaaaatagtttgtacacgagttgccaaagaatggtctaattcagtgtcaggacaaagatggtctaattttgcattatttagtcatctaattaaaaacaaaactagtaataatttagccataaagctgttcattgaagaataaaagcaattgttaattaacttttcattgaggaaagtcatacatttttcatgttatcataacatttcaaaatgccctgggaaattacaaaattaaggtaatgtaaattattgatatattataactctaacaatgaaacattttacccaggcctctaatgaggattctcagttaaggggaggagcagaggaatgcataaacacatgggaggtggggtggagcggaaacccagcttccaggaagatgttttaggagaaaacagattcctaagctatttgaggtacaacagaccgaaggcaatgtgcagtgcaatttatttccctaaacttatctgttataaaactgaatccttaagctggttgtacaaagtcacacaactagtcagttaatgttctacaaatagctctttcagagatttttctactagacttgtcaccttatttaaaccttgaaaccccactcaaaattgacagtgagagaaacagacacacacacacacacacacacacacacacacacaccagggacggagggagagaaagtgtattaatagctaaaacccctcttggccttgggaaagaaactctctaccctctgttaataagaagtgagagagctgcctcctctttgaataaatcaggttctttagacaatgtagagttaagggctttactcatcaccctgttctctggatgccatgtaagctcaccagattcttgtgaaactacagagaatggattagacagtccaaaacataacagattgtacttgtgtttgctctggtaagtggagctttagtttgatgtagagaaataagaggaaccggcatttctttcacctggacattatgaaagagaggtatctgaatcatccaattaagtgagcaggaaatctggaatattgtaggtgttttacatgctcattctttctttctacctgcttaattgtatctgtgctatttctgttaaatgcatctgcggtgaactttgcagttgctaaggagagcgtttgccaattccatatgcctagtctaaggtaggctgaagctaatctgtcattctggagaagcaagagaagctaaggttttcataatatttagttgataagggatgagaactttagatacatgttatctcttactttgctatttttccaaaaatgtatttgaaacactgttaagcagagcaataatatttatgcagcattttacatttttaaagtcctttaaatattacatcatgcatcaaaaattatcgataccaagatgtgattgtctcaattttagagacgataaaattaaaaataagaggttctcaaaatgtcattattttataataactgaacaaaagttttacctcaacatttaacatcaaaaacattttcatttttattagatcatgatgttctgtttgctcgtcacataaaatattttaaagagatgtttggggtttaaacagattaagtatttctatagtgccttgaattaacaaataaaagtaaataatactaaaactacacccatctattgtcttgctatgaaacctagaggtaaagtgtatgtgaagtaaaacagtatttttgaagttgtaatgtcttaccattgcttcaattaaatcgttacatacacacacacacacacacacacacacacacacacacacacgcacacataatatattagatgatagatagattagataggtaggtaggtaggtagatagatagatagatagatagatagatagatagatagatagatagatagacagacagacagacagacagacagataggcatttgtgatccccactgaaaaaaactggcaagcttgcctaaaagtgaggagaattattaagaaatagtaaactacccaaggacattctgttcttttccttacacataaatatgaacgatggtgctcccctttggttccaactttctgtgtttcatcccctatcatgccaccattgtgttagtgtttcccatttctcctttacattcaaagtgttgcctgtcccatttaatattttaatctgaagaaatccttgggatgggaaacacaatggtaaagaatgaagaatcgctttttaaaaatactgatgattacaatgtattcttaacaagctttggatgaatttgtattagtcgcccaaacagttctaaaaaaaatcagcataacagcaaatttgacaacaatcaaaaactcatcctttctgaatatgtccctgaaagaaaagctcagcactgtatgcaactccatcatatggagcccagaacatctctttgtggatatgtgactaaaggcaaaataaacatccagtgtaaaggtgcagaggcaaaaaaaaaaaaaaaaatagagtggtctattggaggaaatacagatggactggtattgctagtagaacggtggtgaatgaagctagaactatagccatgaactagatttttagaaaccagtatcctatacttgggggttagatttcattatgtagacagtagttgtggcaacctatgggattaagtagggtccaaaaacaaatatgtagtagtagtagtagtagcagcagcagcagtagtaacagcaatgacaacatctaggatctattgagcacttaaaacaggccaaatactgttttaagctctttacttgtatcagctatttaattctcatagaaataagtatcattttatcatcattttacaggtgagtgatgaagtatcttgctacacattatggaggtagtaagtagcaaagctggaattcaaacagaaaccagtgtgcctttacactgcaccaccctgtatgcttagggagatcactctgttggcacattgcagggggagaaggacattggagactgtattcaccacggccatatattgtgtgatggtatatttcttggaaagcacaattcgggaacaccatagcagagaaggcaaatattatcagccttctttacaggttagaacatagactcagagtgtttaaattaattggccttacccttctgaatcttcatacactgcactttctacccatcagaattacttattcctatttcctaagatcagtcattccagaaaaaatgaactttcttctttttatgaattcagaaggaccggagacaggtaggcaagacgcatgaacacaaaagtgtcttaaaatctcagagatacattcatttgtgcactttcacttattcattcattcagtaatcatttatagagtcttttatgaaccatgtgctataagctaggtcccgggagtaaaaggcgggagtaagctgacaattaagttttcttttgtccattgaattttgtccaattcgcaggtggtacttggttggttgaacctcctaaagttaccttctagctcatgcccccaactatttgccactttacaaaaacgtcacacacaccataaactgagaaaatcatcagtccagggaggctcattccttctgcgatgaagaattcctatattgtcgcaatattcagctgacaagccatggggtaaaactactgtgagcatttcaacttctgattataccccaccattttttctgatggaatacagagagtggccaaaccagcagccttccttcaggccacatttccccagcccagaagttcctaaaatcttgtggaggcgattcagctttatatttgacagttatttatatttctggccctacagactctgtccgagcaaaagcttttctagacatataattttaaggggaaaatatcaatatttgaagaaaacaagtgtgctggaatgtccctctaccttatgattcatttgttattcctagggtgttctgcagcaggttaagtgggctattgaacaaagaaaaccccaggaattctgacatattctattaccttaaactgatcgaaaatcagcttttcttctgttgagatgaattacttgacagtcagtagaaaaattcttcccatgggtttctcctttctgaaacctttcccacccccagtcctcagaaatatactttggtgagtttcctctatcccaaagcattattcatataatccaagaaaaactgaaagagacttgaggactaatttgcaatgatctgaggtacctgaaatattttattcattttatttttatatttctttgaaataaatacacttactatcctaagggtaactctgatattaaaaagactcacatttattacatatataccagagcctatatccccaaatagaattatttatgagaaaccttaacgcaaataaagatactaagccctcggggcctcttgtgcttttatatttgacatctcctctttttaaatattcatgtagaatagccttaagtagaaacttgaagatgtgctagtataaaacattttcctgagccactttattgttgatggggtgttttctcaatctggatctcagtaagtctttcccttaaatgaaaaagggctatttctcaaaccatgtatgaatgccagcatttgttcagcttctttttttgtttgttttttttttttgagactcagtctcactctgtcgcccaggctggagtgcagtggcacaatcgcggttcactgcaacctctgcctcctgggttcaagcgattctcccgcctcagctccccgagtagctgggattacaagcatgtaccactgcacccggctaatttttgtatttttagtacagatgggatttcaccgcgttggtcaggctggtcttgaactcctgacctcatgatccgcccgcctctgcttcccaaagtgctgggattacaggcctgagccactgtgcccagccttgttcagctcctttagcttactttagagcagtcacaggttgccacttttccagcatcagggacaaagttcagatcaattttataacacgtcgattctaaaaatcacagtctcgtgggaggtggaatatctgtcacaactcataacatatttcctactgcttcatgttccatatattagaaacccattcaccactaatttccccaaatttacaagttaagagtttaaattatagttttataagtgaatttatctactttatttttcaggtcatggattctagctctcatatgaagtaaggtcttaatgctttttatttctttaccttatgttaaatttcagattgatgagctttctaataatattgaaagttcacattactaccttagtagagcttccaaattcaaattgaaatttcactgggctgggtgcggtggctcacacctgtaatcacagcattttggaaggccaagacgggcagatcacttgaggtcaggagttcaagaccagcctggccaacatggtgaagccccgtctctactaaaaatacaaaaaatagttgggtggcttggtgcatgcctgtaatcccagctactcgggaggctgaggcaggagaatcacttgaacccaggagatggaggttgtagtgagcagagatcgcgtcactgcactccagcctgggtgacagagcaagactccaccaaaaaaaaaaaaaaaaaagaagaagaaaagaaatttaagcgaagatgtgagtaactgtatcagaccagactcatttttatatgtaaaagatgaaatggcgttttctactcttaataaaggcaaagatgaactaatacataatgcaaaatgagcactggaagagatatacaagatgggtaagagcaaaactatcaatttttgtatttttcattcattcagcaaataattaccaagcaagtcatacatacgtaaaatagtctttatattttttgtcccatctctatgatagtgatgaaagtgaatgattctttaaaaaaatgataaatattaaatatcggctagatacaaaatattatcattggtgtatataaccagaatttaagttgaatcattggcatcaaagattttaaatagttcggaaaattaaaaaatacattgctagtccccacttacaaggagcttgagaagagaaaataaaaataccaacaaatcaatacagaaatattcactatagatcatgaaactcaatgacctgtaataaagtttaagaaaaacaattttatattgccttgatagaatagcccaaatcatcaaagcagatggaattttcaaagacagtatgctatcatgagaaagacatgtgcggaaactaggaagaagcttgtattctgaatgtgttaccaagaggttacaatgaatgtaataaaacatctttttgtggtaagaaatatggaaagacagtagctgttctactgcattaatctccttccaggttaacaggtgcagcagcagttggcttcagaaactcttgttaatgcgttcctcagactgtcccatctgcttcttattgtttgctccatacaaaggcatgttaatatgtctacctacatatcatcattgtttcattttattatttgctaactgaactgtgccaacatgatagaaaagaatcaagcttactataattttaagatactaagacacttactagtaaaaacaatgtttatcgaatttaagacctttgtggactcataacagagaactagttctgtgcaacaggttcctttcacctcaagccattcaatcaacattttaaaaattccaatacgattgctccaaggacctatgagagatactttggattcaaggacctcagagtcgagtggaaactctttctttaaatagaatgtgacccagaagcccaatatgaaacagatgaagagtgagctattcagctaaaggaatgctgatggtggtagtggtggtggtgggcatccactgtcttctcaccctacacatggcccttgaaacactactaaaacccactaaggctccagtgagactattgtaaaattcccatatattctccagttcctagtttgtccaccaaacctatccacagcttttctttgtttttaacttttaagttcaggggtacatgtgcatgtgtgttatataggtaaacttatgtcatggggatttgttgtacagattattttgtcatccagatataagcctactaaccatcagttatttttttttaatcctctccctcctcccaccctccaccctccaacaggtcccaatgtatgttattcccctctaagtgtccatgtgttttcatcatttagctcccacctgcaagtgagaagacacagtatttgattttctgttactgtattagtttgctaaggataatggcctccaactccatccatgttcctgcaaagtacatggtctcattctttcttatggctacgcagtataccatggtgtatatgtaccacatttgctttatccagtctatcattggtgggcatttaggttgattccacgtctttgctattgtgaatagtgctgcaatgaacatacgtgtgcatgtgcctttgtaatagaacgatttatattcctttgggtataaatgcagtaatgatattgctgggttgatggtatttctgtctgtaggtctttgaggaattgccacactgtcttccacaatggttgaactaatgtacagtcccaccaacaatgtatacgtgctcctttttccccacaaccgtgctagcatctactattttttgactttttattaatagccgtcctgactggtgtgagatggtatttcattgtggttttgatttgcatttctctaatgattagtgatgttgagcttttttcatatgcttgttggccgcatgtatgtcttcttttgagaagtgtctgttcatgccctttgcccacttttttagtagggtttttttttctcatagatttgtttaagttccttataaatgctggattttagacctttgtcggatgcatagtttgcaaacattttcttccattctgtagtttgtctgctcactctgttgatagtttcctttgctgtgcagaaactatttagtttaattagatgccatttttcaatttttgcttttgttgcaattgcttttggcatctttgtcatgaaacctttgtctgttcctatgtcctaaatggtattgcccgggttgtcttccagggtttttatagtttgaggttttatatttaagtctttaatctatcttgagttaatctttgtacatggtgtaaggaaggggtccagtttctatcttctgcatgtggctagccagttatcccagcaccacttattgaataggtagtcctttccccattgcttgtttttgtcagctttgttgaagatcagatggttgctaggtgtgcagtcttatttcttggttctctgttttgttccattgatccatgtgtctgttcttgtaccagtatcatgctgttttggccactgtagccctgtagtatagtttgaagtcaggtaatgtgatgcatccagcttttctctttttgcttagtattgccttggctacttgggctcttttttttggttccatgtgaactttgaaatagtttcttctagttctctgaagaatctcaatggtagtttaataggaatagcattgactctaataaattgcttaggattgccttggctacttgggctcttttattggttccatatgaactttaaaatagtttcttctagttctctgaagaatctcaatggtagtttaataggaatagcattgaatctaataaattgcgttgagcagtgtggccattttaatgatattgattcttcctatccatgaacatggaatgtttttccatttgtttctgtcatctctgatttctttgaggagtgtttggtagttctccacgtagagatctttcacccctctagttagctgtattcctaggtattttattctttctatggcagttgtgaatgtgattgcattactgatttctccctgttgcactgcatgcaacagatgcaatggaacagatttctctctgttgttggtgtataggaatgctagtgattttggcacattggttttgtatcctgagactttgctgaagttgtttatcagcacaagaagcttttgggctgagaccatggggttttctagatatagcatcatgttgtctgcaaacagagatagtttgacttcctctcttcctagttggaggcgctttatttctttctcttgcctgatttccctggtcaggacttctaatactatgttaaataggaatggtaagagagggcatccttgtcttgtgctggttttccatgggaacacagcattccttaaatagacatgaagcccctgcccacaccccagtgaaaaacaactcactacttccagattaagctttttatatttttggccatctctcactgttacaaagtttgtttgtttaaatatttagtggacaaagggctctctttcctttcttctcatcataataagaatatgcttcattgcatttccactgattagctgaatatttgaaaacagctaatacgtccctaaaattataagttgctttctagacaggctccagtttttcagtgtctcatttaaattatgttccccagagctgaacagtacagatttggtctgatgaacttacttttagtgtcaacaaagagggtgttctgggcaccatttcaattactatacttatttgtttttcttgtatctctatcataatgttaaagtcatcgtaaactcttgtttttttatttaatacttttgggtggagagaggggaatgctaacttaagaaattatattttccctattcaattttattttgatgtattaagcaactatttcagtgcctaatatgtgccaggcatgtgataaacagcaggatgcaaagtatacatagtctacatctacatggtgtatacatatagtcaaagaaatattataacagttaacatgtattggtaacttaagacatatgtatagaggaatctgaggcttggtttgtggtcaagatggtatatatataatccttggtttgtttgcttcttgagacaaatctagaaacaactaggccaaagtaaacactatcaactattataatagtcatgactcctttgagtatttattctttcttctggaactctgacagatattgtgatttaagggcgtagggataggaaaggaaaaaaatgaaagcaaagagacagtgagaacactttttagagccagggcacagcctaagatgaagaacaaatgaaagatctacatcagcagccaaaggtaaaaataagcacttcagaaagaaaactgattttccacagaagaaaaaatatggcagacataatgtctgatggcataggctccagatggaataagaaatacacagctgcagagtaaggctatcttcagttaatcgagagaagcctgatcatcagaagcattagccaatgtctgtaaacatataataataaaataaatgcagaaatcactataaatctttgtgttaattttgttttataaaaataattcaagaactgttattttggaaccattatatgtatatagtaaggtaattaccatataagcaattatactaatgtcattagaaacatagattttcagcgtaagagagaagagactgcagttaaaatcaaatatgttcgttcctaattcttgatccaagtggtgatctgagtggtagctatctgtgtttatggtatatggttatgttatgcttcaataacaaagtgtattaaaaatagaagaaaatgcaataaaagttttaaaaagcaaagggcaagaataaagataaatcgtttcttcaataaacagtgcttatcaatcactattgcacattttatttcacttaatttctcagaaaaaccttatttctattgaaaatctctgtatcttcaggcactggaaagactcccaccaatttaactgtaactcggatgttgatttcctaacacaagttcctcccattatttaatttacctaaggactatcagttaccttaatggaaaacccttccacttattatatctctaagttatctaacaatcatgtctcttaagaaaatatatatttttatctcaagtaatctcaagttaagattactacctttaactaaaatgtttatccattcaattaaaatttattaaagtcagctttgcaaatggtatttcttatttttcttcttcctttcatatgtgtacaaaatattaattcaacccagaagtgtttttcctccctaccagaaaggtaatcttattggttaatttattacctcattcacttaacttctacatgttacccagataaactattgtaaccagaacttacattattacgattgcaatatacattattaccaacctgctatttaggagaaaaaacacttcttagatatcataaatgcagctttaacatgcagaactgctttaaaacaggcatacaggaattttttggggggggatgaggggtgtgttatttttaatatgtctaaaggtaatacatttaatgaactatacaatatttataataagttattacaaatatgttcattttatgaatttttattttttcttaattatgaagtttgtaagtatattaggaaggtaataacttcacagcaatgtggcagacacagttgaatgtaacgtactcattaattttcaaaacaatcctatgagatatatactcttaagattccttttgtaaatgaatagactgaggcacaaagaaggtaaataatttgcctgagagcattcagtgcgcaaagtacaaggcacctaatttgaatttggcttcagaatccaactcttaatagctacattctgatgaccctagatccagggactcttctcatccaattccggttttgttgtgttttatgtaaaacacaccactgtgggttatcagattccaattttgttcattgtcttgaggattttatcatttacctgtaaactaaactgaattctgccatctcacccattttgccactcttactaaatactcaattgtttagttttccttcaatatcgggctacatctctccaaattgatgtttataattttttgccttccctcttgacttgacatcactgagaattaaaatctgactgcccaaatccttactgggactcctacaacctactgattctactgggacaacctacaaggttgtcttgtagctgtctttctcccccaggatttgaaaaagccttgcacactgaagcccaagaacttgatataaacttcaaaagacttaccaccacaacaaatcacgtataggcaaccttcatgcctggagctcctgctacaagagccattcagaaagtccactggaactccagcatcatccgtgttctgttccaggaaataactatgactgtgaaattaatgtttatgccatcaccacattcaaaccataaaccagaaaatccatcagattaccactctaccatctgaagatgcttagaattcaatgtctagaaaacttcttaactgcctgccctctagactcaacaaataggatttatattcttctccaacaagtttttgtttttatgtttgtttccatagaggtgcctctcattaaatgcctgatcacgtgcatcatccagcaactatgctctactagcaagtctcaaccgatgatttagctagtccttagtaaacaaaaggcaatcgaatgacaaatggacttacactgttcagaaggatgaataatgtgtcttctttacttgaacaggagtgaggctccaccaagacgctccccttgaccaaactttagctaggctcctctgagccctcttctcagctaggccataaccttggcctgcacagacctgaacaaaaaacactaacatagcttctaacaggtcaaagccacctctctaggataactctagccccacttaaggtgcatttctgagaaaactcaaagctgccaaaataatttaccctttgttccagtcaaaacccgaagacagtgagaaggcaggagcctaaccttaagtgccatttagcaaacgtagaggtttcccagggaacaatcccacctttccactttttgtaatttgttacttccctgactttaatgagccaccactcaaactcattctctcattctccctttaaaactcccagtcacctctacacaaatcaaagttcagttcagttcatgctgaactcttctctattataatagtgtattactgattaaaatctccccttactaattaaactgacgtccacttttgcttatctttggataactggttatttagttggtttagtttcagtttgtgaatgtcatgtggtctcaaaaggtcacatcatatagataaaaccgtgcacgccaacatcaatgaacatgtgaagaaggtaaacatgattattttattgcaccatttgtaaaaaaaaaaaaaaaaaaaaaaggtcaatttaaacgaagtactgcatgattacattgaacgtatttacgtatttgttgaatagtatttttcccttgtaaaattgtatatgttaattatacaaatgttggaatctacagaccatggaagcataaaatatatattgcctcccattctgagaaaatcctattgaaagataagttatgtcatcacagtttttctgtttttgtttcgttttggtatggcttggtttctggcttttgttgttattattttgtctatataggcaagtattcatttatttcctgcattagtcaagggtctctaaggaaatatttgattttatcaacagctgaagtaggaaagagtgcctggaatataatatccacttagaagttttttatggtatggttgattcacccattctatttaacctcagcattcaattactctcactgctatttttttttaaacctgaatcatacattttacatttaatatacactcattgcaaatacatttaaaaattctaataaggcagagcctttagaagaatgcttgactcagaaactcaataaatctttgttaactattgaaggaaattttaattaaataattaatattcataatcccactcaacaaaattactgatttttattaatagttttttcaatcacctgtatattttaattagcatactgtaaagaaagtaatcatttttcctttttaaaataaaaaacactatgttatactgactttatcactgagataatctcaagcagttattatgagctgcttttgagctatttgaaggtacagttttactgctatgtaatttccaggcctatgtacatctaggcataagattttctcagctgttaaagctcgtctcgttgccatttgtcccctcttaatgatagcaagaactaagtcatcccagttttgcacatattatacttgcgttaagttctttttccagttataagaacacaactttaatttcttatggataatttcatctgaacaacacattttagaccgaaacttcagtttccttaataatttgtacttttgattgtgggaaaatgacaacagcatacaataatagaatattatacttttctagctggggaaggctgatgacacaaaagcataggactacaaaatggcaaaaaacatgattatagtgtatacatgagtttttttgcaaagatctgaatagagaaaagcagtaaaatagtcttcacaacatatattgaaaaatgctaaaaatacaataacttgcaccattgcagctagtactatattcacattataaaaggccatttaatgtatccaagacaacattggcagacacattaaggttatgcttttgagttctattgcttttctgtacttctgttttatttgatttgaaaatatgatttgttgttgtagatctatatgccctttcaccataaagagtgtgccctttgttttatattcgtgcttctataggtaaattttaataaaaataattttaatcagcattggttgagcatagggctttttatttctttaaactggcctgtttattactcaggtttgagtagcactacactataccaagcatgaagcaaaatgtcttaacactaggggaagctgagcttggttctttgtagaaaaactctatccaggagacatggggtagattaatacagacattcacacacacctccacacatatgggaaggttgaagaatttgtaacatcatcgttttattaaaacaaaatatgtctcaccacattgttgggtacatgttactgatctggcttaataatatataggatttaacttcctgtacttgatatgcttggaggcaatattactgcagtacaagccagggcatcagtttcactatgcttttgtcagcatagaaagtagcactagaggacaaaatgaatttgaaccaatgaagctttcatacaataccctgaagggtactagtgtaagacaggggcaagaaagaaacagtgatgatgtgagatgtgacccgataactgtccttcatggatctacacaacctctggaaatgccttctgcctgcaagaagcgtcaggagccctagaacatatgctaatatatataattaaggaggccaaagacaatcataccactctattcaacgaaatttatatattcacatacatacacacatatacacgcatgccacatatacagaaatttatgcatacatgtgtattgtagtttgagtttcataataaaactcaaaagtgaagacagttcacatgcacacgaattattagacacaaaaattggaaggaggtaaaggataataaagtgttataataacaggctgaaagaactatgattctgtcttctttatcccaaaatgaacttaataaattaatataacctcaattgcaagaggaagaacacgttgaggttgcatactaaggtgtattttatatctgatggttccatagctatgaaagtcttgatgatgccaatgctaggcatccaaatttgcagaagcaaaatctctggtcagattgaaaatgtgttacagtaaggaggaggtctaatctctcatcttttttctctgcataaattttgagtgtgctaaccacacaataagtaagttgtcaataactactgttttgattgattgtattaatccaaatattgaaatgagcatgtttgctgctttactgcttccttgttaacgcctagtaaatgttaattactaagtaaagtttctgaatgaataaataatccagagataaatgttatacccacacctcaggaatgcccactggtgatctacaagagaagttggggtcaaccaaagtgtataaaggtcatacagaaaggactcaggaggtcaatgtaaaggaggcttccatcgcataaagatgaaaaatatgaggacaataaagatcataatacagaaggtggagagcctcagttacatttaaatatatttaaattcatgcattcgcagtgatgccaaaacaaacaactggatgataataaataaataaaatattcactggtggtcgggtgcggtggctcacgcctgtaatcccagcactttgggaggctgaggtgggcagatcacgaggtcaagagatcgagaccgtcctggccaacatcatggtgaaaccccgtctctactaaaaatacaaaaattagctgggcgtggtggtgcgcgtctgtagtcccagctattcgggaggatgaggcaggagaatcccttgaacctgagaggtggaggttgcaagtgagccaagatcacgctgctgcactccagcctggtgacagagcaagactccatctcaaaaaaaaaaaaaaaaaaaattcactggcaacttttggaagagactagagaagcaattcattattttgaaaattgttcttttgggggaaaaactgaagcatttactctgctttgctttgtatcaattatactatgaggcaaccaaatagaaatgcagagttctctttataagccgggctcagtgactcacacctgtaatcccagcactttggaaagcaaaggtgggtggatcacctgaggtcaggagtttgagaccagcctggccaacatggcagaatcccatctctactaaaaatacaaaaattagccgggcgtggtggcgtgcgcctgtaatcccagctactagggaggctgaggcaggagaattgcttgaacctgggaggcagaggttgcagtgagccgagattatgccactgcactccagcctgggtgacagagcaagactctgtctcaaaaacaaaaaatcaaaacaaaacaaaaagttctctttatagaactgctcctcctaacaaatgaagaagtaaaaacagtatatcattgttttgcaactcataatgaaataatcaatcaaaacaatgatcatcaatggctgccaatatcaaacgttatataccttttgttgaaagtacacaacactttctatacaatcatcttgagtaaaaaaagaacaaaatcaaactgactacaagtagctctctagacttagctgctaatttgtcagcaccacaggagctggtgaaacacattaaacaatatcatgtggatgtaatcaacaaacctagacaaaaggtcctgtttcttcaaaaatgaaaagggagagtgagaacgaggatgagggaggaggaggatgtagggtgtggaggaaacagagacaacagagagaagagaggagtcctataggataatttgggaaatataaaatgtatttgatgatattaagcaaatattttccggggctgggtgcggtggctcacgcctgtaatctcagcactttgaggggccaaggtgggcggatcatttgaggtcaggagttcaagaccagcctgaccaacatggtgaaatcccatctgtactaaaaatacaaaaaaattatccgggtgtggtggcgcatgcctgtagtagcagctactcgggaggctgaggcaggagaatcatttgaacctgggaggcggaggttgcagtgagccaagatcgtgccactgcactccagcctgggtgacagagcgagactctgtctcaaaaaaaaaaaaaaaagaagtggggtgggggggttacttgggaatacagtctgaaatgtttagagtagaagtgatatactttcggggatttgcctcaaaacagagaataggaagtgggtaggtagagaggaaaccagatggtaatgataataatggttagagctaatgagcagtgtatggtatgcattatgttacttttttattttgtatatgtttgaaattcttcataagagaaaaaataaatggtccatgtgcacctgtaacataataatgacaagatatgtcagcctaagaataaatatgtcttaagttatcccctttacctcatcttggcttcaaagtaactatatgctttaatcattatagtttgtctaggtccccagagagtgtttttagatttttatttgttagtttatgaacttcagtcaagtaatcagaaagccaatataataaaatagtctttaactttctggaaaacatgcaagcataaataaccatcatttatacttctgtagcaacagtgacattgaatcatactcaaagcaaagtatctaagattcagagtaagtaggattctcacttgtccaatgcaaagattcagctacatctggtgggtaaaggagttaaatattaacttcatcttttagtatctatttagatctaatttgtatagggggttaaggatctcctgataaaaataaaattaataacttaaaactctccataattagacaacatattagctttcatgcccatcaaatatgaggagctgcaaaaagcacagtgtcaaggggtaagtctagtgttctcacgtaaaaatcatcttgcagatacagacaggataaactaaataataatgaggcctaagatttggagtggaggaggagtcccaagtacaccttgatggctgttacctgcacttacaaccaaaacagccattttcatgtcaaatgtgtgccctgggatacaagatctatgtatacattttaaagaattattttattacaagtcactctttggggtccagcaactctactatgcctcctttataacagagaacagattaaaacactgagaatgggaagtttccccttgctgcttcatggatgtaagttgagtagctgcgacttcatgcagactgaaagaaccaagcaaagcaccaaacagtggcattgaagaggttgactgacagtggtctagggcacagtttgagctgcagcacccgtggagggaaacctctgtctagattatcattagcgtagctgatagaggtgagaaaggttctgggagaagcatccaatcacagagctaagtcaagcatcagtccaaatttcagaatgtctgagtgataaacatcctgcagggacaatgatgcaaattggagtagaaaacactgaagagtggccaaggtcttgcaaatgcacatggagatgctaacaagctagcaaaatcctggtataaagccaacactacccatgattacacaggttcataatgccacaggcagtttaggttacaataaaattcatgaattcttcagtgcttggctgggcaggatatgtactgaacaaagcactcccgtaggtactgaaaggcagtgcctattcactaactggtgatgttattcatccgtttcctgaaccaggaacataggagcccctttgtctcctctttcatccctcccagccagtccattgctcaatgtctaaaattggattccccaagatcagacttaaatgacaaatttgagtccatgtagctgattatgatggagatcacagaaagcatcaacaggaagtgagaaacaggaagatctgtgatggagatcacagaaagcatcaacaggaagtagagaagtgagatagagaagaaaggaacacacagagtacattaatgagcaagttatgactatggatgactgggacttaatgccactggagacttctagcaaatgaaatagacatgcctcatgcatcctatttgagtgtaaaaagtttagagtttttatcatccaattctcatctattattaacctgaagaatgctgcttgggtcttcaatattccagcacttctagccttccccgcagtggcaaacccatcagagaaagtcttcaggtgcacgcaattagatgatgagacaaaatgggagcgctgaaagggtacggacagcgtccactagatttaaagagtaccctacatttatcttatagtgtagactatagctgttcttgcttttttgtaccaaatgactcatctttttttccttcctttagaaacaagattgaaaatgtaatctcggttgaacaggaagcatggagatagttcaactgaattggaagttgctggttgtagaatatttctatgcattcttcaagacagtgccatgtgaagcctcttctgacctgtccagttagcttttatttctctctcttttgtgacagcactgtactttgcacatcttattgtttcattcttcacacttttcagtattatacttatctatcttccagtaaattcttcttaacagactatcattttcttgagagcaagaattgggtcttcgttcatctttgtattttaggcatggagtatagtccccaagaaccagtaagtgttcatcaaatgttcatctgttgaatgaataaatgactgtgtgcattgctgctaatgatattcttcaccattttcttcagaatctgcttatgctggtcagattaaatggctttacttgagctgtttccaactttcaaacagattttttttttttttctgacagtgatttaacaccactgaaagttttcagttaccttccagttgttttaaaacatgaaatagctatttctggtgaaaggaaataaaggagaagagatagttctcacttcaatttgagttttgagaggatcgaattgcttcagcccaaggggtcaatactgacaggtcatccctagcagctggagagtatgtcaagataatactccaaaagatatttttatccttcatttgctacaaagataaataaatgcatatatacaaagtgaacaaaagctttgaaaatagtaaaatgttaacataggatagtatagtcactgttattgaatgaatgtttgtgtccacccaaaattcatatgttgaaatcctaactcccaaagtgatagtattaggagatgggtttggggctttttgggaggtgattaggtcacgaggatggagctctcattattggaattagttgcctcgtaaaagagaacctacaggccaggcgcggtggctcacacctgtaatcccagcactttgggaggccagggtgggtggatcacgaggtcaggagttcaagaccagcctggccaaaatggtgaaaccccacctctactaaaaatacaaaaaattagccaggcgtggtggtgggtgcctataatcccagctacttgggaggctgaggcagagaattgcttgaaacccggaggcagaggttgcagtgagccaagatcgtgccactgccctccagcctgggagacagaatgagattctgtctcaaaaaaaaaaaaaaaaaaaaaaaaaaaaagaacctagaacgctccctttcccctccaccatgtgaggaatcatcaacaagatgaacgtcactgaggaagcgggctcacaagacacctaacatgctggtgacttttggactcaccagcctctagaactaggagcaacacatttctgctctttataaaccacccagaaatataatatctatatgtatatagccaccacccatatatgtacacacacacagtttatcaatttttgaagtgaaataacatataaattaacaaaaattctctcacgtgctaccacatacatagataaaatatgtatgtattttatacatacatatatgcatgtatacatacatatacataaaacatgtatgtaccacatacatagataaaatatgctaccacatacatagataaaatacttgcccagatacatagataaaaattcaagtaccatcaaagtctaccttcttcctatctataaagctataaaatgagtggtatgagactaaacagaaatgttctgtgctttttggcacaaacgcatatttgtttatttattatgtatgtatttatagtgttttcatacaaatagaacaatttgacatatatataataaactagaacacatatgcacatatgtatgtacatgtatgtatgcatacatatgcacatatatatgttctacttttgtgcaattaatactacataacgatcacatttcaacatctgtttatataaattcatctcttgtttaaaactgtagtataaagggcacaggcatggactaccaccaagctatgtccatttagattacctattttactattacctagctacaaagaaaacccatgtccatctaaacccttactcatgtgaaaacataaatgaagggcaaactccttgaagtagaattgctatgtaaatatgtaattatacttttaattttgaaagataatgccaaattaatctcaagagtctgggcttgtgttactccatagtcaatgatggcgatggtcctcaactcttgcctccaaaatgcattcattcttgaataactttgatcagatgagacacttatgatctcaatgctcattctcctactactctttggataaccttgtttgacatttttttttacagtgtgtaaagcaaagagaaactccaaactctttacaaatatgctttgctaaagaataagacctatttgatagcacaacagggtaagtatagtcaataataacttaattgtaaatttaaaaataactaaaagagtgtaattggattgcttgtaacatgaaggataaatgcttgaggggtgtatatcccattctccatgatgtgattatttcacattgcatgtctgtatcaaaacatctcatgtaccccataaatatatatatctattgtgtacccacaaaaataagatactaaaaatacaaaaattagctggacatggtggcgcacacctgtaatcctagctccccaggaggctgaggcaggagaatcgcttgaacccgggaggcggaggttgcagtgagccaagatggcgccactgcactccagcctgggtgacagagcgagactccatctcaaataatactgataatgataatgataatgataataaaaataataacgaaattcagtggattctgaataaggcacaataagaagaattttctttttctttatttagtcttaacactgaaaagtcttaatgaatgtgtatctaccatgtgaaattagacagaatttaacagtttaaaatattaatggaaatatttttcatttaatctatttgttctaaacaattgctaaaatattttggttacatctaacctcacaaaggcaaccattttctattacttttctatattcacttttttcctattatttactgggtttcttctgttattgttgttgttttttcctttttgagacagaggttcactcttgttgcccaggctggagtgcagtggcgcaatttcggctcatggcaacctctgcctcccgggttcaagtgattctcctgcctcagcctcctgagtagctgggattacagatgcctgccaccaggtcaggctaatttttgtatttttagtagagatggggtttcaccatgttggccaggctggtcttgaactcttgacttccagtcatccgcttgccttggcctcccaaagtgctgggattacaagcgtgagccaccgcactcagccagtttgttaggtttttattaggtgcaagattgtgctgtattttttaatcaataaaaacacaagcaagccacagctccaagaagtgtacaacaaatgatttgactggagaataatttttttaactaaatacttggtcacactatataagtggcatgtgaagaaaaaacagtcactttgggccgaaaatttcagggaaaaaaacccttatggagtaaaaataactttatagtttattgctgaatgatttacatttttattgatacagctaacttgtatatactcagtgttagttcttaatcatatttaatgcctgttacacatgccacattcctcatgaaactattcatgattcttctccccataccaataatttgtattattccattctcatataacatgttttcggtatgcttttaaattgacaatatattttaatttctcttataattttctatgttctatgttctatagtattaaaagattcatgacctagagacacacacatatatatatatgtgtgcacacatccatatatatttaactttatagaattcttgaatttgactgaatagaaagtggtggccaagaatattaaatctacctaaaattcacagaggtttgagattcacaaaaggtcacttgatttggcttacaggttcaggggagaaaagtaaatttcatggaagaaaatcataaatatttgcgagtagataaggtagcagatgtagacgttatctatagggaaatctgacagcaaaaggaatgagagctaggatgttacattcaggggcctgaattacagtttgctacagatacaatacatccgcacttagcaaaaattacatttataaccttggcttttaatcaaggtttaccataatgaaaagctgtgaagaacttgtatgactcgcttataatttttttggttttttttaagatagggtcttgctctgtagcccaggctggagtgcgatggtgcaatgatggctcactgcagccttgacctcccgggctcaagagatcctcctacctcagcctcccaagtagctgggaatacaggcatgcaccacgacgctctgttaatttttgtattttttttatagaggtgaggttttgccatgttaccctggcttgcctcaaactcctgagctcaagtgatctgcccaccttggcctcctaaagtgctgggattacaggcatgagccactgtgcccagcctaaaaaaattgttattgatgtcactaaaaactgctcaggaggaaaataagtaggtcttattgtgatgaaacaatattttattgaaaaaaattgatcaacattttttatttaaaaacaaaactggggctattttattcagtaatatgccagtattcacatagcaagagttttgagcataggctttggagcctgagcatctaggttcaaatcctgactttaacatttattagtgggacgatgggtaagttcattagcatctccgtactttagtttctttccatatgttaaatatggataataatggtgtctaattcataggattcttatgagaatttaatgcctgattataagtgaggttaggatggtaccttgacatagtagctgttttatcattgttctggattattatatttattatctatgcctattttatataccatacatgcctgtaaataaagtttgtctaggatgccatggaagaccagagttcaccacctttgtggagatttgataggattttcaccattagataataagagctatataatgtatgtttcctctttagtctgggctcccatgattcttggtgccaaacgttttggtttaaattcagtaactccaattgagccatatttctgtcaaattcttccaaatgtcaactatatgtggcttctagtcaatttgaccttgttttactgattctgatttagtggcaagatggtagatgaatgcaatggtttattctcgtgattttaaatttaatcatttgtaattatatacttttaagacgtaaagcttcacctgtcataaaacatgccctttatggcacaatggttttaaaatatggtcccaaaactcattggcaaatggaaaggtagggtctatgtcctttcctcttcaatctgggtgagtttgtaactacttcaacagatagaggatggcaagagtaatgttttgtgccctccatggcagggtcataaaagaccatatgactactaccttgtttgctagaacagcgtttgcttggaaccctgagttaccatagaaaatgtgtgagtatcgtaaagccaccatgctaggaagaagccaaacaacatagcaagttcacatgtaggccttcagaattccaccctccagccattgagtccaacttagctttcaagtcttgacagatgaggctatagatattgcagagcataaacagaacatccctgctgtgtcctatctgaatttattactcacagcatccacggcataataaagtaattgttttaaactgctaagtatcagggtgattttatacacagcaaaagtaagtgggataccctgccaatatgtctacatatttccaaacaactgaaaacatgcacaccccaaaatgttttcttaatgagaaaatacaactcacttttttatttctgtgccttgattaaaaaaaggcacgtccactaaaagaatgataatttttattctgattatgggataaagaaacatatggccatttgtgacatacaaaaagtctactggaagcaaaaagtgggaaaaaaaagccttacgaatacccgtaaactggtgataaatggacaaacaaaatttggtatatccatacaatgaaattttatttagcaaataaaaggaatgaaagactgatacattctacaatatgaatggaccttaaaaacattatgcaaaatgaaagattacagacactagaggccacatatagtatgattccatttatatgaaatgtccaaaataggcagatctatagagacacaacacagagtagcggttgccagaggctagagggagagaggaatggggagtgactgctaatgggcatacagtttcttttggggatgatgaaagtattctgcaactagatagtgatgatagttgcatagctctgtgaacatactgaaaaaacactgaattgtacacttctagagagtgaattttacagtatgtgaataatatcttaataaagctgctgtaacaaaatccccaggatatcccatttctaaataaacgtatttttcccttgaggtcttctgatgtttacacctctttttgttgtgctgtggctttttggaagcagatttctctgggtttgttcatttttgttttatttcagtattagaaccaaccctgcttatatatcctgtctttttttaaatttaaggcttaacaacaaacaaacagtagcaataatcccaattcccgagtgattcaacaagttttattgtgcagatggtaagaaactgtttccctcattgtttgctaccaggagaaaggctgtgaaatagttcttctgggtcaaaacatatggttcacaaaaatgacttcctttcatcttggtctcttcttgccttctgaaagaccaattcctcctaattttaagtttacttttggcaaaatggtctcatgtattaatgactttatttggttaacaaagtaacatgtttacaggcatgggagaggataaatgaagctagaaaaaggagtactgaaaatattaggttaatgtgttattgttttcaagagccatctataacatccttgaaacttacacaaccactgactaaacattttatttagaataatcaggaaccagtggaaaatctgcttatctagaccttgaagcatcattttttttttctgaaaatttcttcctgattacatccagtggcagatactgctatttgcttgtttgcttgcccaatatccaataaacccagcaaagaaatagttgtcttgatggactattaacagccaacccacagtaaaaacaaattctaaaaatttaaaaagcatagtaaccaaaaaatattcactccacattttgctttttaaactttaaaaaatgctttttttttttttttttttttttgaaaccctgaaaaagtagacagtaagccagctcctggaagaattggaaatcaactgcatgagggtctaggaagctgagaggctgaagcagtctcaggacaagtagatagggaggagtcctttttctctcaacaacaaaatcgtgattttgtttagaagtagcaaggtgtcaagcaagaacaaagagctctatttcaagcatctctggcacccagtcatggccttttggcatctgagaggacgacagctagggatttctgggatagttttgttttcctgatgtacatgctgcctcttccttcttcttgcttcctttttcatctttctgctctgaaatgtaagacttgaggctggagatgttgaaaccatcatcttgcaaccaagagttgacaagcatgagaatgatagtaaggtgtaaaagagcaagaagatcaaaggggcctgggattttcatgccatcacagggccagtttcttgctttagactccattccttcagattccatcatatgagaaagttaaaatcctctggttctagtttctgctacttcgatgcaaaaatgcaatccctggcctggcacggtggctcatgcttgtaatcctagcactttgggaggccgaggtaggtggatcatttgaggtcagaagtttgtgaccagtctggccaacatggtgaaaccccatctctactaaaaatacaaaaattagctgggtgtggtggcgcaagcctgtaatcccagctactcgggaggctgaggcaggagaatcgcttgaagctgggaggcggaggttgcagtgaattgagatcgcgcctctgcactccagctttggtaatagaacgagactcgtctcaaaaaaaaaaaaatacaaccctcacttgcagttcctctcaactgggcacaccaccataccctgggtacatttaagaaacgtgaaagcactgtgattgtccccataacggatggaaaggtgctctaaggacgccagacatccagtaacacgcaggaaagtccaggaaaatgagtaattgtttcatgtcctattcagcttttgaaaagtaggggacagcctgtttataagtatgtgaatatatagaacctagctcaattttacatataaatacaaagtctttatatgcactgcattttccaagaatgaaactatcccacaataaatcaaagggaaaatgtgcacttattttattcagaactttaccaaatgttattaatcatacagaaaaatcccattactttaaaatatgctgttcatggcattttaatcattcataccactcacctgcatacgtcagcatttcgagctgtctacttctgtggttttaggtacaggtactacatttatctagagcagtatgtacctttcttattttcatattgaataattaattattgatgataaatatatccattatttttaattcattattgtcctttgatttattttttacaaggtaattgttttagaattttatatatatatgtaagttacatttttggtaaattctctttgaggatagtaatgggagtattacaaaatatgtcttacaaaagagggtgttcagtcttacagggttaaaacctatacggtacatagaagaaaaaaagtttttaaaagaaacacggtagcctggcgtggtggctcacacctgtaatcccaacacattgggagtccaaggtggggcggatcgcttgaggtcaggagtttgagaccagcctggccaacgtggcaaaaccccatctccactgttacaataaaaatacaaaaattaaccgggcatggtggcacacccctatagtcccagctgctcaggaggttgagacaggagaatcgcttgaacccaggaggcggaggttgcattgagccgagatcatgccactgcactccagcctgagtgacagagcaagactccatctcacaaaaaagaaaaaaagaaataatgtatacatatttagaaaataagataatacacccaattgattaaattatgattttcatctgtaaatgttcctatgccttcagatgtttattttaggactgtggccgacttggttctaaagaagatggatcaccaggtcattacagggctttccttcacaattagaaactaaatataagactcaacccagagtaatttcagaaaaaaaataaaataccaatataaggtgtattgtcaaagataattgtgctcctgcagcttttctgtgtataatagactcttccttccttgtagcagcttgcctagattgtgaaaaacatggtgtttgacccttagaaaggtcaaagacttatataagatatatatgtatatatgagcatatgtatgtgtgatatatatatatatcacactgatatctatatatgtacatatatcagtgtgggaaggaaatggaggaatagaatgttaattggaacaagactagtagtagctgattagttcttcattccactaaacataacgatgggcaaatatctagctgctttaagtcttattttataaattgaatatcaaatactaaagaaaaaatacattttcacagccaggaaaaacatagaatttttttcaaatttcaaaatgccaagtaaaacttgagaggaaataccgagcaaataaggaactttgtcccaaggtatggaaacattgacaaaactattaccagttatagctgacctttactgggtaaaacctggataaacaggaaaaactttaagagaaaagtcttcttcagtgggtcaaatcccatggttttcatgaactgggcggactgctacagggcaggaagagtttactacacagagaaaagttgtgggaacacaattatctttgaagaactcttgggccagtgtaggccccgtggtgccagttccctgtgctaagaggcagccagggatatatacctcaccctttgctatatagctgccttgcttagaaacttcttctaagagaaatgccttatcttttcagatttatattaaatattttccaattctatttctgcctttatctcaggaaattccaagtgagtatgaagctcatgctccctccctaaaatagcaaaatagcaagctctttgcatggatttttaaaaatttatctttttttttgagacagggtctcactctctcacccagattggagtgcagtggtgcaatctcggctcgatgcaacctccgcctcccaggctcaagtgattcccccacctcagcctcctgagtagctgggattacaggcgtgcgccattacactgaactaatttttatatttttagtagagacgggtttcaccatgttggccaggttggtctccaactcctgacctcaaatgatccacctgtctgggcctcccaaagtgctgggattacaggcatgagacactgcgcccggccgtatgatctttttacaaggtttcaagtaacaattttatttcctttgcttcaaaatttccaactattgccattcaagtgctttccactgatagtctgcaaatacacaacccttgaagaactcattgtaactatggccaaaagagtcactgttttaaacacaatctcacataaagaagacttaaactaggtgtactagttgactccatctagaaaattatttctcctagacagaaatcttagattaggcaaatgtgactgagctaaacaaagtctttataatttacaagttcttagggatcaattcttaattttgtacaaaaccacaattaccaacatatgatctccaactctgacaatggggtcttatttttaatctccattataaattggcaacagaaatcttctcatctcatttcagtaaagttggctttgccaaaataaagaaactctctttgaacctgaatcagatgatggatgtacaagtcacttattttctgggcttagagttactctggagagtaaccaatgtttaatttatcaatgttcctagaaattaattagtttaacatgacctactgttgttaccaaagtgtttttcatactaggtaatacaaattgggcctgattatctaggcaattgtatttaattttctgttttggttcatggcaaccaaattggcacttataactttttcccttttgtccaaaattccattggaatgacggaaggtattcatgtgtttagaggaataaaattataatcaacctagaaaacaagaaagcaagcaagcaaaagaccaagatactggtgaaaatactgaaagatgtagatgggatctcactggtaaagaaaacaaagaagagtcaataaaaccacaaacaccaggagtaagaagaagcttcacacctttggttgacaaatagtgtacttcaattctgctggctgttgtaaaggagattacaggatacctggaagatatataatgggagaagtagtctcatatagaagctattgtgggtttgggtcctttagaaatttctctgaggaagaaacattaagttgtggcctaaaagatgaaaaaggaggctgatagtagtcctgtattttaaaagaaaatcagtatcaccgtaatttagggagggaggttggagagaagtggaaaatcagaaagagatagctgttaaaaggtagagccctataggttgtggcataaactttacagtaatggacagctattgaagagttataaacaacagtcaaataaatgttgtaaaaacatttattccatttgccatattgaaaatggggtacaggggccaggcgaggtggttcacgcctgtaatcccagcactttgggaggccgaggcgggcagatcacttgaggtcaggagtttgagaccagcctggccaacgtggtgaaactccgtctctactaaaaacagaaaaattaggctggtgtagtagcaggcgcctgtaatcccagctactcgggaggctgaggcgcgaggaatgcttgaacccaggaggcggaggttgcagtgaaccgagatcgcgccactgcaccactcctgcttgggcgacagagccagactctgtctcaaaaaaaaaaaaaaaaaaaaaaaaaggagtaaaatggagtacagggtattaggaagaatatataaagtacaataagatagacaaatgcaagttttatgcacaaatgaacatcgttagaactccgacacaatgtcttcttcccttcaaatgtcttcacttttccattcccactatcatccttcagcctagtctctaccaccagttttactgacgcgtcccccaaacggttccttcaccctcttctccaacctgctcccaagtatccttcatagtacaaggaaacaaattttccgaatcataatatttttcatttcatttttctgcttaaaaatttatcatgtcttcatattacttatagatggagtttgagaaaattattaaatctattccccacctaggttcgtaatcaattaagccgcacatataggagtcagacgaatagagatgaaaatatctcctttactaatgataaagctgttatcagcgaacatagcattaagtcttcttattatgtatgtttgctaataatttgcctagtgacatccattagtaagcattaaatggaagaagaagcattccctatataatttatatcatgggggcttaaccccaatttaaagagcatgaagccatacctactcaattcctcctccaaaaatcagggtagatggttcatttctgctttcttaattggagtacatggagggacagggaaaacgggcaatattattaccctagcgtagttctctccacaattggatatttgaaacaacaagcaaggagggtccaaagatttaattgcatatacattaacagtttttgtctcattttcaatattctttagagtttgcttattcaaacttcttgctaattatcatcacaagccgctatttctgtcattttccttgtgctgtccatattacttgcctcttcttttaactctagtaccaagattgactgatgataggccattcaatcttttccaaagccgaggttagcatgcttagctgaatgagttcgggcaaatttcaattttatgcggttcatagcaatagccatattaactagtatgtttatttgtctctaaataaggtttaggtattctgaaatgtctctctagcactggatttccagttaatgagcatctcactagaaatttatattgacaacaaccttattaatattaatcccctagcatttgcaagactaggacaaaatttcagatatcatttatatgatatttttgaagacattttataaatacaacaaatatgatggattatttctattactataactaaattatgttttgaaataccatactatttactaagagctataaaatgtgatagtatcctataaaattaatatctcaataactctaaaacatgtcagttgaaaatagtgcatatatattagtgtgaatgtatgtgggggtatgtcaaaagagaatctccttaatacaagcctctgctggaaataaaaaataaagaaaaaaagcagaaaatgaattatttaataatttctaagatgttctcaggtgccaacacaacaaatcctaatgaacccagggttgattaaatgcagataaagaagatatgcatttttcaaatctcatgaagagaaaaaagatttttctgtcgatcattctctaattaaagtattaacggtaagatagagactgtattccctcttactggaaagataaactgtatgtttctataatatatgtcaccctagcaacaacacacaaagcatcaactgcctttaataaaaactgattttataattaaaggagctaactgttgaaaaatagtcactttttatagacacttgaatatgaaaattggtttctcacacctcattataatactaagtgcaaattagtataagcctttgctcatccattccaagtaaagcagaagcacagacagatcaaccaacctagcactgtacatgacacgttgtaggaattcaactagttctgttaatttaaatacctgcaatagtttttattatatctgcactatggatttttaaaaaatatgtaacagcaaaaaaactaccaagaatatttataatataaacagttttttaaaaatattctttctcatgaaaaagtctatttaggaacttctggtaagggtaagataacttcgacccatttttcccttcctcttcccactaaaacagcaacaaatgctggtaataatgcaggaataaacccaagataactctgaaggtagtcagaagaagacgacggagttttggtttactgggtctggagcagaagttgagtgacttacatcttttcacttaatagaagcaagtgacccagactcaccatttcgagacccacaaccagcagtcgaaagcagcctagaaaggcttatctctccacatctaagaggattccctgagacaacatcaggttctcctgacactttctaggacaggatgggtagatgcaatccagagaattgccaacagtaaggggaaacactctctgttcctggtgggcctgcttcagctctcatccacagatacctgtgaaggagtaaaggatgttccatccccaaatatgccagattggtatgttggctattttcagttggaaactttggagaaattgtagtttcagaaagagttagctcacctgtctcttcctacatgcagcaaaccataaagattcctctgggaggggcaccctcacaggaccagagtgagaaaatagcccttattaccagagacttagaattggaggcttcaatggacctgaataaatatatttactgaagtaacccttatctttcactagttttatacccactatctatctcctagtgactcccctagagaaaatttactgtccctagccagattctctttatcctgtcattgctttccaaattcatcaaattcatcattcatcattaaaagcatcttgctttgactacttcttcaggcttcactttcttgtgatgatctccacgtacatgtataagtaatacaatttgtattcttttcttttgttttctgcctgatgtcgatttggtttctagatccaactgaagagcctactaagaactaaaagggggattggaggtgatatccaattcccctacacctgcacatgtgatgaaactgtacagaactaaatacacacacacacacacacacacacacacacacacacacacacacacatataggaacaccgagagaaactgaataaaattgctgaattgtagtaatgtcaatattctggctgtgatattatattatagttttgcaaaatattaactttagggaaaaaatggtaaagtgtacataggatatccgtattatttcttattaactgtatatgtatctacaattatctccataaaatgtcaatttttttaaaagtcaattttgatttttttattttctgtttggatttcactagatgttcttattgattttattcactatataattgagaatcatcttgctctgtgtttactcagagcaagctgaactttcagcaatcttatttttaaaaaatgctacatgatatgaccttatcagcaatttactaagttatttgaatggactttatggacatgaacttatcttcaaagcgtcttttctgtttaaagctatgtcctttaccgttttttttaaactggaagcattccttccctgccagctaaagaaaattccatgttattaaaaatggtggttctcagccataattaatacacatagttcataacacccatttaaaattggtaatgtgtttataagagaggtgagacatgcaagaaaagaagtggtaccaagtgatcaccagagacacatggagtgtgtgagtgtaggagagttatttaacctctgtgctatttatttatttacttatttgagatggagtttccttcctgttccccaggctggagcgcaatggcgccatctcggctcactgcaacttccgcctcccaggttcaagcgattctcctgcctcagcctcccaagtagctgggattacaggcacccaccaccacacccggctaatttttgtatttttagtagagacagggttttgtcatgttggccaggctggtctcaaactcttgacctcaggtgatccacccgctttggccgcccaaagtgctgggattgtaggagtgagccaccgtgcccggcccacctctgtgttttactttccctatctataaaaagggaagtaaaaatagtatcttctacttaggatagttatgtgctataatatgtgaagcccttatttcagagccaagcatatagtaagcacttccataaatattaattattattattactcatggaacataattgattcccattagaatttgtaggagtaaggaggtaacactttaaatctactttgttcagagctgcttctcgctggaaaccttttaagtagtgtttgtatcaccttttctcctagcacttacatagtgtactgcttgtgtaattaactccatggataaagaaatatccttccccttccatttactagctttttaatagtgcagcttcaggtcttccactagaaatattagaattgtcacttaattttcaacctcccgatatttaattgaaagatgtacaatataatttaaaaggtacctacccatagggcaactaattctgaaaacgggtgataagtgaataaaggaagtatgcttaatttcattttcatgctttcgcagtttctatcttatattgataaagaaatcctaagctctacatctgtataagaatgtatcatcctttcaatatacttgtatctatataaaatgcagatgtgtatattcttgtgtgtgcatacacacatgcacagctatagaatatagatattttaatttagataattttaggactttacataaaatgaatcacatatgcactattatgatgttttccccaatgcaagataatattttctaagattttagacataagatgtattttatcatgtacaatgcactctaaaacttaccaagtttccatttacaagggaaaacgattaaaaccacaaattgctatagttaagagtttgggattattttattttattttacaaatgagagcattcatttctgaatacctaccataacacatgcatacatctgtcagaaaaaaaaaatcatatttagaatccaagtttactcccggagaaccttaacctatttcaaaaacatctttgggaagatgtcaggaattttcacaatttctattacactcttctgatttgagtcaaagaaaataattttcaacataataggacagcccagggaggcgagtttcagccagttgctgtggaaaaaccagaggcagtcgctgtcatgcagctgccaacaccacagttgggggccttgccaagtagacagatgccaaaacagaaaaaatagcttattccaattaattgttgaaacctataaaggtaaaacacttcatgtgtgggcctgactacagaactgctttgtcccccaaaggcatcgtgtatttgcttttcattgtgggggttgctagaaacatagaaataatattattaaagtatagaagatgtccaaggaacatgcatctttcctctagcaaagaataatttaaaattaaaataagtattatacttattacttttctaaattgcgacttctctccatgcctcactttccctctctgtaaaatggagataatagcatcacactgctattttaatgagaaaagtgaaataatacatgtgatgtacttaatggtgccaagtagttagcatacatcaaacatgagcaattatattattcctattattataccaagttagttaaacttgtattattttactactaatatttgtattactgcactaagttagataaatcaaaaccattgttaaagctgatctagaagtaagttattagacatttctgtttaggagatatcagttacttagaaatttagttactataaataagtcttacatatagaaaattacctttttttggtgactttagaaatttagggcgtaagaaataacttttcaaagaaaaaaattatgtcatcattttaaagagctctctcagtgagtattaattgtgttcatagctagataaatgtgtgcacacacaacacattacggccaattcaaattttaaaacaatgccattatagtggaatttcatcctattctgtatgggatcaaagcatccagaggtctaaaaaacattaaaataaccaatcctctaggtgctttttaagttttcagttaatttgtcttatctacattgaagcaaacaatctaaaacttgcaatggatatctgtgaagcatacatcaaaagaaaagtatagtagctgttagttcaaggaactgaatgatagagcttccaattaaaaatacacacatgtgttgtttatcttatttcagtgaactaaaaggttatttgcatttcttgtaaagtgtgctcatccctttaagtttcagtgaactgtttgagaagacatagggaatgggaatgcattttattacaacctttccctttatttggaaagattattcggtagctgtttctgaaatgtctagtactactgtgaaaaactagtacccacaatatagttctagaaacagaatagacaaagttgcttctgatatctttctgtctactagtcaggaatgcaagacaatttcagatcaatgatccttctactatcaaaagtcatgggacctaaggatcaagatcacttttatttttgctccatttgaattatccaggcaaaaccaatgacataaatgaggccttacgtgacctgacatccctatgcctgatctagcaggactgtgacatcaacagtaaagctagacggatcaaaaggtgcctccaatgcccgtgtcagcgtcagcttcagcagaagctccccacttggcattcctgcttgagtgctttgcagtcctggcatgtcacctaactggctggtgcttcctaataggccctacaccacttctgattgatgtgtgaatatgcaaaccttactggaatccaggagccagatggcccacataccaagtatagcagccagacaaaacagaggcagattcagcaaactgttggagagttacatttttggtgattcctacagacacctaagtatacatagtcctatttaattgatttcattccatgttaacccacaacaatagtgcctctgtcattaaactgccacattctaattaaaggagaaaattctttcttttctcctttccatttagcatgaaatgaaggcttttataatcaacctgattctaccctgctacttgtagaggctgtcatgtagtctctaaaggcacaggtgaacaaaatctctttgctgcttctctaggataaagcagtcacttatttctttcattaaacttagatgaattatttaaaacaaaagccataacttgtataaaagagtgcccagatgagggtgtatcctccctgagtgagtaatatctagtatatatcagccacacaataaaaaatgatgaaaatggtaaaaattataaaatgataaaaaatgattaacaaaacacaggaaaatcatatatacatatatatgtgtatatatatatataaaatcacacacagcatgtctcataatgaaaagtagaagttacttaatatcggttttctttttttacatatgtaaaatatcattcatgggtgtacttgtgtgtgtgcacaaccacattgaatggagacatttcaattagaacttctccgatagaagaaatttaatccacaaataggaaaagcagtatatctcagcgttaatcacttatgccttaaaaataatcatgatagcaaccaaaattctttctggaatctgaatcagccacacacatgtgtttctgactttattcattaagattagcagccttccagaaatcactaaaatggaatcttcaaaagctccagttcaagatctggagataaaatgaaagtctggtgatcctttccatagactctgaggactttctttaccgtcttaatgtcttcaatggaaaaacgaccgtgtatgacaaaataataagtttgcttcctgagcttgaaatgaatggctgcctatcagatccactctgagcatatcacttcaggctgtcaggccagccacattgctcacaatttccctttgggataagctaatcctaaaatcattttatagtttggatagtttcagcatgagatattgatgtctttgtagaagttctattgcataacatatacatggaagactcaagttatacggatatgtatgtactacactaattgtgtagtgtgactatgtatgcattaagaattttaatcaattgtgtaaagggaagcaaatgttcatctttcatatctcaaccaatagttttggttctcatggaaatcaaacattacctttttgtaataaaatcagtgtttcaacagaaatatatttcacaatgaaccttgtttataatgaccatctaaaatttctttaagagatgggcattacaggtcaaagataatctgtatgaaaaaaatacataagatattataaaatgtagcttaaactgttgtgtattaggaaaaatttaatacaaattctgctataattcaaaaagaaaataatgaagggaaataaaagaaaagaataaagtggaacaaaatgtgtcacataaaacaacatataccagggtagggtactataaagttttatttctacagctttgaaagaagctaaaaactcacttgtgactctgtagctcatgagtaatgtggtcatttcaaacttatggtgataaaactttatggcactctagttcagaacatatgtcaaacagagaaaaaagtaaaaatcaaaatgaaatgtgacaaaacactgcaaaacccttctcatctgacaccactattctggttttgtctgggaatcggtggtcaatttcattttgaaatttctgtctcagagtcatgtagcaacttaaatgactgctctgattagcatcaaagtaagtgtagaaaaatgatttgctttcatcatgatggtgttaacaatatgtacttcagaaaatgtcatcgttagtgttgctaaagtaagaacagaagcataattcctgcagttaaattccaatctaagatatttgaccttcacacgaaaagaatgaagacaaagcctttctcttttaaaaactatttttatggaatatattaattttagagaaaatgtcatgtctttacaatgagagctcaatattttcaaatgatgtggttatatattaaatgaatacgttcattttcttaccattaaatttttggtattagttctgggaggccataatttttctacttaaatttttgcctgtatataaaaagtactttgtgtaaatagagtccaatttgactttagtttattagtattaattagttgtattttgtcacttggacaacttgcaaaactttggtgttattctgattgtcactccattttcttagctgtagggccagaatctaattaatcctattattaatagttgtctaatttctcactattctgttccttagcctaaaggtttcataactctgtatgaaaatgagaaaacctgtcattgattaatatatgtttgtttttgtattaattgtgcaactgcaatgttactgcacatagaaatgtaactccttgattgaggagcacattgccacacatggaatctccaaaatgccaagtgaaaatcaccactcttaagagtttatttcagagtgttgactaaattgtttggggacttctttgcctataacataaacttaagagtttttgaggtacttgttttccttttaatcaaatacttagggaattataagtgtcttcttagagaccatgctttcatgcctagctacagttgaccaactcttttaaaaagctttgtctcctgaaataataataggaacaaactcaacatttctaagagaagaagacaccgttatcaactgagtgcagtgtaattcatcagtcattgataaaatcatattctagattaatccaggattcattcaattatttctaccaaatctctttcccttcaagagagggagtggagttagttgtcatccaaaatgctaatccaaaataataagggccatttaagagaagttattgagttgctttagaacttgtagattctatgctatgctgtcactgtaagtagcattattttagaaaataaacccctaaaccttaatttaacatgaaatggttcataactacaaccacctgaactgtgatcaaatcatgtcacttagatccatgtaaagcagtacttactacacccctctcacctggagagtttactgaaaggcatacctagggaaaaggcattcatctagtgctgccccagtttgaaagcgtaccaaaaagtattcacacaaggtttgtgtcacacaaggagaaactgtatgtgcctgttcttgaaacccacagcagtaatggtaacagaagaataacaagaatacatatcttgattccatataccaagctttatcctagaaaaggttgggattactggacttaaaagaacatggtattccgtaatcagacaaccttaatttgggaccattctggagactgcttaccacagtgataattatacctaatttgttaaaattcattttttccaattataataataattagaaaactataaaagtatacaaatgcagtacgttttatcttagttttcttctacttcaaaattatatatattatctaaaatttgtttttcttttcaggttatttctaaggtactttgatttttgttaaataattcagtttaaattccacgtttttatgtagaaaaaaatcaaggatttgatttctcttatattcaaaagtgcaatcgttttctttctacattgagatgaaagtattttggagcataaacaatacacgctaaataattgcaaatagcttttaaaggctaaagtttgcaatactgaagagctaaaccagcattgtccattagaatttttggtggtgataaaaaacaaaaaatgttctatacatgcactacataacacgatggccactaaaaccatgtgactactgagcacttcaaatgtagctagcaaaatggaggaacaacatagtttcttttactttcactaatttaaattcaaaataattttttgccattgtctaatggctaccaaattggacagcacaagtctagaatttaattactaatacatgtatactttttttattggtacatatgtcatataaggttgtatgcgcagaagcatacagataaatggatgccatcttgttactatctaaaagccaacatacaaatgttttatgacttaaaaaaatgccacagattcttgcttcactttaatgtgaggaactcagatatttattaacataattttgaccaaaagtagcctccataccaaatgcaattatttagccatttctgcaagactggagattttttccccaaaaactaactagaaaaataacttaatcctctgttttaatatgccatttcacagcttgcaattgcttattgtgaatgctcctatttcttttcttgaaactttggcaaaactattatgccagaacatgatttacattttgtcattcatttaaaattcagaatggctttttatgccattaagtctatttatttacattaaagacaaatgcatacttaacaatttggagaaaacaatcaaaagcttttgaatcattctaattggtgagggcttattctttaaaaagtaacatctatttgatgtagatctgtgatctgacagaaaactaattgttttaagtatttgtaatccaagcagcagtgatgcaaatgaatttaattatcagtttaaaaatccaaacaatgggaagtaagacaacacgctgccttcaaagctatagtaataaaagaagtgctagtacatttcctcatgtacctggaaatgagtggcccagatttgcttgcactaaagtctacatgcctaattttaatcattttgattgtataatcaacttcccccagtcatttctaaagataaattaagatgcatgctttcattaagaataaaacaccctgatttcttcatatttctaaataacttgccttttccaggttttctgaggtaagaattcctgaatgatactcacaaaagtaaaatgtacactgaatctagtaattatatttattttaattttctttctttaagaacagactgttggccaggtggggtaatctcagtattttgggaggccgatgggggcggatcacctgaggtcatgagttcaagaccagcctggtcaacatggtgaaaccccgtctctactaaaatacaaaaattagctgggcatggtggcaggtgcctgtaatcccaactacttgggaggctgaggaaggacaatcgcttgaacccaggaggcagaggttgcagtgagccaagaccacgccattgcactccagcctgggcaacaaaagccaagctctgtctcaaaaaaaaaaaaaaaaaaaaactgtctattttatattgaatttgagtaaaatgcaaaatatgcagtgaattttactaaaatcaatgtattttactgaatattagaccaacgcattgtagttggggattgcccctttggcaaagctcccatttagttcccaactattctgatttatagctaatatggagaaaagttaggaaatgaagaatttttggactgacacaattataaaaccaagaggaaaaagcctacagtttttaaaccaaaaaacctaactttagaacccggatttgtgagtaagtagtttgagcaagtcatttagacaaatgctcttcaagctataggtcaagacatttgtgagctgtacaacccgtttatgtgtcataactgccattaatgtaaaaaatcaaatagaaggctggtgcggtcgctcatgcctgtaatcctagcactttgggaggctgaggcgggcggactgcctgacctcaggagttcaagaccagcctgggcaacacggtgaaaccccgtctctactaaaatacaataattagccaggcatggtggtgtgtgcctgtagtcccagctacttgggaggctgtggcaggagaattgcttgaacccaggaggcagaggttgcagtgagctgatatcatgccactgcactccagcctgagcaacagagactccatctcaaaaaaaggaaaaaaaaaaacaaatagaaaagaatgaaataaaattattaaagtgtggctacatatactaaaaatgccaccttttataaaacttttgttttatttctgcatgtgtctgtgtgttttggggggtactggatcatcaagagtgctcactttttctcttaaattggattgtgaacaatgtaggggagaaaaaattgatttcctcgcctatcacaaggttcatagctgagacccctatagcaaaagaaaggttaacaagagaaaagcatacaaatgtatttaatataaattttacaaatgataccaggacacaggagcattcagaaatgaatacctaaagaaaaaggggagacctgtgtatttttatgctaaatttgatgaagagtggacaacctggcagaagtatgattggagaacaaaagggtgtaatctaatggtaataaagttggggtgggggggaatgtagcaaagcctgtttgttcagtcttctctgtgtcccagtgtgacattcctttcctttaggtatgggacacatgaggggtcttatggcctacttcagagcaaggccagataattcttttctgatctgcttcagaggaaaatggtggcagaaggtcagagactttctcacttccgctgtttcccgaaatgccaaggtgccatatttggggatgatatgtcctaaatcccactaacaacaaatataaaaaaggtggaagcccccaatttaaaaaaaaaaaaaaaatagattgtttaatcatttgaacttgggaatcttgaaaatattaaaaagaatcctgattctttctccgtttagccttgaacaagttatttaactattctctgctttggttctgtcatatgtaaaatgaggatactaataatgtctatctcagtacgttgctttaagaattaactgagagtgcacatatatctttgacaaatcaattaaaatacctttggatatatatccagaagtaggaaagttggatcatatggtaattccatttttaggtttttgaggaatctccatattattttccaaaatgaccatactaatttacattcccaccaagagtagacaacattctgaccacaaaacataagttagtgaggtgatagatatgttaattagcttgattgaatgtttctgtaatatattcatagattaaaatatcacattgtacaccataaattactcaactgttacttgttcattaaaaataaataaataaggtcagtcaccgtggctcacgccagcactttgagaggctaaagcaggtagatcacctgagctatggagtctgagaccagcctgggcaacataggggacccccatctctacaaaaaataggaacattagctgagcatggtgggggacacctgtagtcccagctacttgggggttcaggtaggaggatggcttggaggtcaaggctgcaatgagccgcaatgactccactgcactccaacctgagtgacgaagtgagatcttgtctcaaaaaccaaaccaaaacaagataaataaatgcaattaaagaactcatgcaaatccattataacaatgcttgacacttaataaaggctagccatctgtatgacatctctgttctatgactttttagttacttttaggtttaatgtgaatgttttttctttctttttaacttaaatgccgtataaagcactcttttaaataatgtacatagaaactttatctaaaattcctagttatgtgattttgctaacaggcatatttttcatggaacaaaaagtcacggacaacaagccctcattgtccatttttctcatatgaatttctctgtacttgaaatgttactgtcaggacttggctctgccctgcttctatcatgcctgtcaccttattcaatagaaacaagatgagtgttcttggcattgggaagcaagaagttagtattgtaagtatgattatttcacacaatactagaaatcgttgctgaggaacagcctgcatattgccacggaagaaggctgggatcctgtaccctgagataggccaagtgaaataaggtctattcatagacttgtatggtagttacaacattggttgttttagataataatgtagacttcataaatcatctaacacttggaaaatattacgtaccatatagtaaactcttgaaagagcattttagtacccccagaacaatgcttgaaaatttaaggcaaattacttccaaatcaacacaattttgagtgtaacttaactctggcctttgatatggtaaactgccaattatagctatctagctcggatttaaattgaattagattaaactgtgacccagtgatttttctggtttcttatgtggtcagtgcaaacagttatatttaatggtggtaaagctgagataaaaacgttaaatgtaagagtcaattgcaaggtcattttctttccaagtaatgaaaacgtagtacttgatccgctgtaaaattacaggctaatgactcagtcctacagagtagctctcaaaccttgttcgatgtacccacactgatttaagcaaagacaaagtatcattttgacgattaaataatgacaaggagcataaatcacgtcttagatggtgccacaaaatacaaattttaaaggtctcaatagacatttttggataaaataatgagaaaaaaatgttcaatcaaaggtggatggtaaatatttacaaattttaaaaataaatatttataagtcctattacttaaaaaagtaatatagtacacattgtaatattttaagaaagttttagtattgttttctgaggcatcaaattccattttttgaaagtatcatgaagaaggatattaaagtactttagattgccctgccaactgtaggagaccgaaatatgccatcccaaaatatgtcacaaaatatgtcaagaaagcaggcttgatggccgcggtggctcatgcctgtaatcccagcactttgggaggcagaggcgggcgggtcacctgaggtcaggagttcgagaccagccgggccaacatggcaaaacctctaccaaaaataaaaaattagccaggcatggtggcacacacctgtagtcccagctacctgggaggccgaggcaggagaatcgcttgaaccctggaggtgaaggttgcagtgagccgagatagtgccattgcactccaccttgggcgacagagcaagactgtttcaaaaaaaaaaaaaaactagcttgcattttattgctggatttctcaagttgtgctcatagggcacaatggagaaagaaaaacatgttctaataacatattttcaaggttagccattgtcaaaagttttcattcactgaaataaaacagattaatgaatctataagaaagcatatgtatatttgcctttttctgttgttatttttatagatttaggaggtacagtgtagttttgttacatgcatatgttggatagtagtgatgtctggtcttctagtgaaaccatcactccaatagtgtacattgtacctaataggtaatttctcactcctcactcccctgccacaatctcaccttttaaaaaattttgtatttttaatttttgtgggtacactgtaggtgtataaatttctggggtacatgagagcctcccgccattttttttttttttgagatggagtctcgccctgtgcacccaggctggagtgcagtggcgcgatctcggctcactgcaacctccgcctcctgggttcaatcaattctcctgcctcggtctcctgaatagctgggattacaggcacgcgccaccatgcccgactgatttttgtatttttagtagagacagggtttaaccatgttggtcaggctggtctcgaactcctgacctcgtgatctgcctgcctcagcctcccaaagttctggggttataggcgtgagccaccgcacccggcccctctcaccttttgaagtctccaatgtctattattccattctctatgttcatgaaaatatgccactttgacacaggactattttgagctaaaggcaattcagaagaagcagatataagttctctgccctcccactatttgcctgaaaacagtacatacatttgcaaaggtgtccatcctctcctctctatcagaaaggacaaagtttgatcaccaatgacaactttagatctttatcagcccggagactgcatcagaggaatctacataataaattttcttaactagcctttatctaccatcagtttcccatatatttgccttcctgaaattggccactcatagagactcagggtccttttcccttgtcttgttacttctcaaaaaacgtattgttctttgtcagagaaatttattcatttttccttatatatctttcatgtatacatgaggtgtgtatgttagtaaactttattgtttttttcttgttgatatctcttttgttataggagtcccagttaagaaataaaggtagaggctagatgcggtggctcacacctgtaatcccagctctttgggaggctgagactgaaggatcacttgagctcaagcattcaagaccagccttggcaacatagcaagaccctcatttctccaaaaagtaaaaaaaataataaattagcccggcatggtggtgcatgcctgtagctaagctaccggggaggctgaggtggaaggatggctcaaacccgggaggttgaagctatagtgagacaagattgcattaccacactccagcctgggccacaaagtgagacccagtgtcaaaaaaaaaaaaaaaaaaaaaaaaaatcaaggtagaggtaaaattatgttttcttcccctatgcaatgtgtttcttttatttaaatgtttatttagcaaattgtttacctgatgaacaactaatctgagagtgagtagtatgagcaaatggcttttgtaaagattttctcaaatttacctgacttgagctaaccacattcagattttaattactttaaagttctctacctatttatatatatatatacacacacacacacatttgcatatatatgtttatatacacacacacacacaaatgctacatatatattctaattgttttattcattttctgtgtattttaactaacttattgagatgcttgaacaaattgaaatgctttttataatgcttttaaaaataatcactacatataacatattctccagtagttgaacaatgtaaagaatttcttatatgtatgactttattctaacattcatatttcttgggtacttactaaatgttaggcactcacagctagtaatgtaaaatggtgggcaaagtctcttccaaaactatagtttataggctaataatggaagctttaggacacttttccaataattacacaacatgttatagtttgaagtgtgaaccttcgaaacagaagttgctggaaattcagtgtccttacactattcgaaggatttatacatgcagaaccagaaaacaaacaaacaaaaatatctcagttaaaatcagtcacttcagaggaaacaaattgatcgcgatagcagtagggaaaattttggagaaaaaatgttagctttgaagcaagcttgtccaacccgcagcctacaggctgcatgaggcccaggacagctttgaatgcagcccaacacaaatttgtaaactttcttgaaacatcatgagatattttttagatttattttttttagctcatcatctatcattagtgttactgtatttaatgtgtggcccaagacaattctcccagtgtggcccagggaagctaaaagttctgacaattctgctttgaagactcccttttaagttggcaatgaatgtacttacatgattatgtaggtattgttacttaaatgtaacatgttacgtttaacatgtttaaacattgatgaccaacgcagaatctcagcactttgggaggctgaggcgggcagatcacgaggtcaggagattgagccatcctggctaacatggtgaaaccccgcctctactaaaaatacaaaaattagccgggtgtggtggcacgtgcctgtagtcccagctactcaggaggctgaggcaggagaatcgcttgaactagggagtcggaggttgcagtgagccaagagtgtgccactgcactccagcctgggtgacagagcgagactccatctcaaaaacaaaaacaaaaacaaaaacaaaaaacaaaaaaaaaaccgaaaaaacaagaaatgtcttctgaccaatttctgtttctggtctgtgcatttgacttgagcacagatccattgttgcatacttgaagcgtcacgtacacgtgttgagttaaggaaaaaaagtcacattttcttttgatcactctcccatgtaacttcgttgaaagttacctttcattcctttttccatatcatttcctgggctagtcttacataatgttcaaacagggatcatgtaacgaattccatatcagtttataagctagactattaagattggtaaatgtatattttgtgttttttttcttactgctttggagtattgaaaggagttttagtataggggtgtttttatactaaacatactttagtttacataatagagtgtacatttactatacatattttattcaattcacaattttttttaaatcttgctttgttcaatagtgttcattatatacactttgaacctggcttcaaaaatagtacatccttctctattttatgcattttatatcaactatatgtaattgtttcaaattaagattttagataatatcctgtcacattacacttaggttgtctgaccaatagtttcttaaagattcctctatagttacattttctagtttcctttgcaattaagtttagccatataactgggttctgacccatgggatgttggtggaggtgacaaaagtcccttcctgacttagtcagaatattctaagacccctctatagctatgctgtgtaatgtggtagccactagccacatgtggctttggagcacctgaatagtggctatcccgtgttgctgagatttgctggaagtgtaaaattcacaacggaatttagagaggtggtacaataaataatgcaataaataatactaattgatatagtgattacctgttgaagaaataatatttttgttttacatatagttaaataaatattattaaaattacttcacctgtttcttctcagtttttaaatgaggctataagaaatgtaaatactatataaactttttgcaatacatttctattggatgtgctgccaaacttctcaggattcctatatatctttctattctactacatctaccattcatttcttcatcattaattattctatattttttattataaatttactgtgcgctaggcactctaattattccattgtttattataaatctactgtgtgccagctactcttctaataatcacctactgttaagacacaggatgggacatgtgacttcatgataaaaagggggaaacaccctgatataggaactgaattttacaagattttttgtgctccaacttcagtccctgccagaacaagcaaaaggagtgactacaatgtgactttctaaatggttgtattgaggaccacagatgctgggtcctgcctattaggaagaatgggcacactgagttatgaaatgataaaagactcctgtgtctcattctttggccttcagggactgtggtgattttgcaatgtctgtgaattgcccagggcttcagtgactgtggtgatagttctaaaacagggacacacagctttaggaacagtttcagtctataagtctgactatatgtacttcctgttgataaactcatgcttttgtcagtcttttgctaatactgaaaaacactcatgaaccatcctccatttcccattattattcaaggactttagacattcagagttctcagacaattttttcttttgaagagaaaatgtgggtggtttctttacaacttttttgttttgtgtattattattagacactgtctaatgttacatagaaaagaattggttgaagacaagaaagacagcgtctaacagaatataaaataaagaaaaacaaaaccaaagcattcaaataattaatatgaatgagaaaggtatcatttggtttcgtttctactttggctagacagtttcagtacttctgacttttctcataagtctttttttctaatattttaagcattgtttctcttcattatcttacttaatctaaaacagttccctcaaaacctttttaattctcttttaaaatctctacttttatatcttttaaaaatataggcatcaacattatactttaatactaacaaattttactatagaaaattgtgaaagaaccaaaacaacagtcctcttgttgtaaccacaagagcttactaattcatttttaaaagaaattatattgcctattcattccccttttggttaccttcttgctcaagaagtaaggtactttgcaaatggcatagttgatcccagcacctagatatatacatctctaatcaagtgccttttctattcagaaggtaaaagtgtaggtgaattatcagcccaatataataagatcttatcagtgtgtcactagtggagggtgcccaggttcttggtgtcttgatcaaagaattggacaaaatgcacaaacaaagcaaggaaggaatgaagggatttatttaaaatgaaaagtacatgccatagtgtgagagcgggctgagcagcggctcaagtgcccagataaagaaaatcttctggggtccaaataccctctacaggtttcccattggccacttcatgctcaccccacgtaaatgaagtggtggcctgcaattggtctgattggttgtggaaagcaaccaatcagaggctgaagtagagttacataggacactctcctgtgcaaacatctgattggttgcaaaaagcaaccaatcagaggctaaggtgaagttacaaagttgcacttctgtgcaaagactgggcccgcaatcagtctgattggttgggaacagccaatttcccatctgctacacagaaaaggtgggaggtttgcaaagggagtagcctctggtccttatgttacttaggggtggaaagttagggttttgccttcagtttagtcctagggaagtcagcgtgaaatggccttaggttcccttcctccagaccctattctcctgcctcaaatgtgtgatatttttttctcgaaaaaaaaaaaaaaaaaaaaaaaaagaagaagaaaaaagaaaaaagaaaaagaaaaaattcctcagggacctctgcaccaggtgtgctaaaacagagcaacacatgaaaatgtacttccttttcctaatttttcaaaattttaaatttttttattttaatacttttgggggaacaggtggtttttggttacctgggtaagttctttagtggtgatttccgagattttggtgcacccatcacctgagaagtatacaccgtacccaatatgtaggcttttatctctcacccatctcctacccttccccctgctctgagtccctagagtccattatatcattcttatgcctttgcatcctcatagttgagctcccacttatgagtgagaacatacggtgtttggttttccattcctgaattactttacttagaataatggcctccagttctatccaagttgttgcaaaatacattatttcattcctgtacttccctttcaaccacagaaaacaaacaacaaatgttatcatttatgaagaataaaatcttgtgtattttggggagtggaagaaaggtagcacttcttttataagttagtgctattattttataacttgagacatctgattagcttacctataacaaagtggaaatagaaaatatataatatacagtaaactattcatataatgtaactgtttagaatcttaactatcaggcagtgtatttaatgatctttcaagttgcttcgtattttctttttgtccgtttttttaattcaaattattggtttactgacttagatgataggtttgttctttagcagatatgctgaaatgtcttatataaatagtctctgaataaaatcacaatatcagctatcataaaactctacttacatagctcgtttaatatattattagaaacagtcttcattttaaatgcttcttccagaatgtatgcacatattatatagtgaggcatacttaaatattaacaggacattgctgaccttccaaaattgtattcgatgtttcagaagtaagttatgatactacaatcagtaatataaagcattctgctatgactttattcttaaaagagagaaactaaatcacatttacttgaaaactggcatattgaaatgaaacatttccatcctttgtggagatagagaacgctccagattcttgaagagaccatcagagaaaatctaggccaacatttattgttactaaatgcataaatttctctttcagtatcaggaaaatatatgagtatgaacatctataaatatgttttaaaaattatttgaagcctttccaataaaatgacaggaagaaaaccttttaaaaaggtgtaactctacaagcataaagaaaacaggagaagaaaaatgaacaactcaagatgttagcaaattttgggaagtacttccttgccttatggctctaacaaaggctgcaggctcacccactatgttccttggccaggatgaagtatcatatattcttctaatgagctgtgacttctttcagtgtggaatgagacttaccaatgaatatctgcatgctaggtatactcattactaccagaccttcccagctgatagaaatatatttttacaaaacacattttaacaaattgttagtttttattgaaaatttatatttaatatgatagttttccctaagttttaatttataattttatgtttccctatcccttcatcgatatttatttttagtgtttttctggttatttttacttgtgtatttttttataaaaagtttataatcaatttatccaactccagaaaaaaatactacttattatattggaatgcctttaatttacacattaacttaaaaacaatagtttactttataatgttaagccatgcttttcaggaacaaggagcatctttctccttgatttccttttgggttgttcaggagagttttaaacataggtactgaaatttcttgttaaatgtgtttcttgtttttgctgttgttgctattgttgcaaatgggtgtgcaccatccataaaaacttctagctcattacctataaaatgaattttactgattttgcctgtaaattttatagtctgctaacttactaaattattttattggtatttgtttgtgttcatatttgtgtttgttaatattattgttttgtgtgatctcttgaggtaaacaattctatctgtaaattgggatcccattaccactgcttgcaattgttttgcctcgaattggtttatcttgtctggttgcaatggctaatattttcaacacaatgttaagtattaatggaggtagctgtagtactcatatggttttcctgtctttatccagaatgcatcagatgtttcttctttaagtaatgtacaaacttttggactttacacacacacaaacacacacacacacacacacgcatatatatatataatatgtcaacaaaattattcaattctgttttatattaaatgtactttaatcatgaaatagattttaattttatcaaatgttagtatctcacacttaaatataaaccaaaagctaagatcacttgtaatttgaggaatgacttcaataatgagaaacagttcctcaaaataaagcaaataagaacaaatgggaagaagacagaaaacatgagcaatgcaagcagaagagaattatgggaaaattataattgaggtccacagaaagttaggagagaaataattgtattttataaaacaaggtcatgacaatataaaaaaatgaacaaaaacacctataattgacatcctatttagtggtgagaaaatgaaaactttctcaggaagatcaggaacaagacaaaaatgtctctcttaccactctttttcaacatcatattggaagtcctagctaatgcaataagacaaagaaaatagacatatctattggaatgtagaaatgaagctgtatttcttcatagatgacatgaccatctatgtagaaaatctgaaagaatcgaaaaataaccctggaaataataagcaattgtagcaaagttgcaggacacaagattaatatataaaattcaattgtttcttacacaccagcagtgaacaagtggaatttgaaatgtaaaacacaaagccatttccactaacattttcaaaaataaaatactgaggaataaatctaaaaaatatacaagatctttacaagaaaactacaaaactctgatgaaagttatcagaggaactaaatgaatggtgaaatattcagtgttcatggatagaaagactcaatattgtaaagaagtcagttctcctcaagttgatctacagatttaacgcaatcccaatcaaaatcacagcaagttaccttgccttatatagacaaaccgtttctaaagtttatatgaaaggcaaaagacccagaataacccacacaatattgaaggagaagaacaaagttggaaaactgacactatctgactacaagacttactatgaaatgacagtaatcaagacagtgtattggcaaaataatagacaaatacatcaatagaacagaatagtgtggaaatagacccacatgaatacagtttactgatctttgacaaacgagcaatggcaatagaatggagcaaagatagccttttcaacaaataatgctgaaacaactggacatctacatgcaaaaaaatgaatgtagacatagaccttgcactctatcagatcagaagagagacaaagatcaagttactgctactggatttacaagttaacgttcactggttgtacacactcatacaatgctagaggcacttgtatcatctctcattgttccttattttttaatagagataaatgtatttattcttgttcttgaggataaattttaggagttgaaaataaatactccttccataaaaacatactaaaactaaaattattttcaatgattttccatgggaaatttacctatactttgccaccaaactctctcttgcaatagtctttcttatcccagtaaataaccatcccatccttccttttgctcaagctaaaactgtttttctccactctctcaatctccatttttagtccaccagcaaatcctgttacatctactttcaaaatgtatccaaaattcgatcatttctccccagatccatggacatcaacctaatcctagccacacgcacacacccagccttcattactacattatcctctaactcatctctctacttctacctttacatcctacattctaacttacattatttctggctactgttcagaactctcaaaatctcctaatctcccacaatgtacaagccaagacctttacaatggtcaataaggccctatctgatttgtccttctaataccactccacttgcagatcctaccgctcttcctcagtcactctgcaccagccatcttgactcccttgttatcccacaaacacgcactccctcctcagagtgtacatattcttccctctgcctagaactctcttctccaagacacctgcaagatgccctcctttccttccttcaggttttttgtatgcctcttaagtgaggcttttccaggacccactacataaaatggcaacctaccctttgaaatatccctattctacccttatcctgctttattttttctcttagcacttgtcactctctgaaattctatattctacttgcagagagaaaaaacaaacaagttgacaaacaaatatagagaacgtcagatagtttgctaaatgtttccctctttggtttagctcgctagctaacagggccttatgattaaagggacttgatctcttaactgttatattcaaaacactagagcacctgatatgaaatagatagagaatgtagacttcatgtgtatttctgtcaaagcatgtttccttaaatataaattatttgtaaaggataagaacttcaagtacagatatgatactcaaaatatttattctctgactgacataataactgcaggtaattttaataggactagttcctatgaaaagtactctccgtagaccttgtagatcgaagacatttttttttcttcaggccaggtaaactaaatcaaagaaagaaacatttagcaaattcatctgcaactctcatttgttctcattaaaagacagctaatgctaaaccaaagagtaacttcacacatttctaatgaaaaggtctcttagtttgcactcatcacctggccacaattctggacaagaccgaaagtgatcacttgtttattgatcactttttgtccatttttactattacttatctctgcatatagaactggcatagtgaaattagctaaattaggatacaaataagcaaagcccttttaaaaaccatactctgccttttatgttccaagatacatacaagtctgccctccatgtgcattacaagaaaggtttctacagttaaagttatatcagtacattactgtcagagtagatcttaattctttgtgttctggctaccatgatcataatttgaaatataattctaggaatccataggaatcttggtaaggttaaaaatgcaacacccttaagtgaagcacagaggaagaccttcagagtgtcactaaaatgaaatccttctgctgaagcaaagtaaagcacaaaagagagattgaaagactctgtaggtcaattggaaatgttttattcttaagaaaaatatatagtagcccatgaaaggattgcagtgaaagaaatttgcggatacagtcaatagtaatgccacaacgaactgtttttttctaacctttgaacacaattatattaatatctttattcatcacctatctgccctgaaacacaaaataactaggattgttaaaaatatatatatacatcagataagtatttttaagtcttataacctaaaacaactatatatacgtatatatacgtatatatacacataaatgtatacgtatatatatacacatatatgtatacgtgtatatatacacatactcatatatgtatatatacgtgtatatatacacatactcatatatgtatatatacatgtatatatacacacgtatatatacgtatatatacatatgtgtatatacacttatgtatatatacgtgtgtatatatacacacatacacacgtatatatacacatgtgtgtatatatgtatatgtgtctatatgcatacacacatatacatatatgtgtatatatacgtatatatgtatatatatgtgtatatatacgtatatatgtatatatatgtgtatatatacgtatatatgtatatatatgtgtatatatacgtatatatgtatatatgtgtatatatacacatatgtgcatatatgtgtatatatacacatgtgcatatatgtgtatgtgtgtatatatacacatatgtgtatgtgtgtatatgtgtatatacacatgtgtgtatatgtgtatatgtgtatatacacgtgtatatacacatgtgtgtatatgtgtatatgtgtatatacacgtgtatatatgtgtgtatatgtgtatatacacatgtgtgtatatgtatgtgtatacacatatgtatgtatgtgtatacacatatgtgtgtatgtgtatacacatgtgtgtatatgtatatgtgtatatacacatatgtgtgtatgtgtgtatgtgtatatacacatatgtgtgtatgtgtgtatgtgtatatacacatatgtgtgtatgtgtgtatgtgtatatacacatatgtgtgtatgtgtgtatgtgtatatacacatatgtgtgtatacgtgtatatgtgtatacgtatatgtgtatatgcacatatgtgtgtatacgtatatgtgtatatgtgtgtatatgtgtatatacacacatatgtgtatatgtgtgtatatgtgtatatacacacatatgtgtatatgtgtgtatatgtgtatatacacacatatgtgtatatgtgtgtatatgtgtatatacacacatatgtgtatatgtgtgtatatgtgtatatacacacatatgtgtatatgtgtgtatatgtgtatatgtgtgtatacacatgtgtgtatatacacgtgtgtatgtgtatatacacatatgtgtgtatacacatgtgtgtatatacacgtatgtatgtgtatatacacatatgtgtgtacatgtgtatatacacatgtgtatatatacgtgtatatatacacaaatgtgcacatgtgtatatatacatgtatatgcacatatgtgcacatgtgtgtatatatgtatatatacgtgtatatatacatgtgtgtatatgtatatatgcatatatttgtgtatgtatatatgcatatgtgtgtgtatatgtacatatgtgtgtatatatgtacatatgtgtgtatatatgtacaaatatgtgtgtatatgtacatatatgtgtgtaaatatgtatatatgtacatatatgtgtataaatatgtatatatgtacatatatatgtgtgtatgtatatccatatatatatatatacacattttttaaaaaataggtataggttgagcctctcaaatccaaaaatcccaaatccaaaatgctcccaaatcagaaaccttttgagggctgacatgacacacaaaggaaatgctcattggagcattctggatttcagatttttggacttgagatgctcagccagtaagtataatgcaaatattccaaacgaaaatccaaaatttgaaacatttctattttcaaacgttttggacgaagaatgctcaatcagtatcagattgattgattttgagtcttttaactcattcagtttttgagtatagtccccacaaaataaatcccaatttaaatcaagtacttgcattgattctcaactggaaaaaggtcattcccctttgagggttcaataaattcctcagtggggtttcctccaacattctctactacagacctgattaaattactgaaattctaacactgtggttctcaaagtgtggttctttggccgtcagcatcagcatcacctgaggacctgttagaaatccggattcctgggtcccaccctagacctatggaattagaaactctgactatgggcctcagcaatccatgttttaacacattttctaggtaattccaatgcgttttgctgcatcgttttggagtgtgcatggtatcaaacaactctacaaaaatggtagcctgcttgcttttccattttaggtctctatgtctattgccaaatgtaaagggtagacttcagaccaaattttgcatgaagcattagtggtggtggggcagtctaattcttctatcattgcctgttgttttagagcttcacagtcttcaatcagaagttgcaaattaacatgactaagccattatcttattgttggctcaaccagccccacaacaatataattcttcaagaatggcattatatgccctctcacaacctctcttcttcactcctaaagatctcccttgctactactcacctgacaagtcatacttctttgattattacacatttctacatgcaattccttctgccttcatctttcttgaaattgtctctgcgtagacaacaccagactaaatgtcaccatattttaaaaagctattatcctctccaagcaattagtcattctgtcttctatgttcccacagcatttctattgcattaaagattatgttttattttaattatttgttgatgcaattgtttcctttctcagatgataatctcttggagagggaaaaccatgttgggttatgccttcatcactgtatgacagtatgattagcacatagctggcattcaataagtatttgttaaatgttgaaaggttattttagtaaacatatatctctgataggatggtaccagagtgtcaattgttcttttctaaataaaaatgcttcactaatgtccatgtatgttgttttgctagaaagcaaaataaaatcagataaataatggataggcccatcagccataaagaattggtttttttgctagcaactatcatgctaattggtaaatatttacatatgcaagctaaatatgcttggcactgagaccactccagagaatataggtgtaatcaataattccaattttcttgtatcaggacatgataacctagagaccaaaacatttaccttctaaaaggaattgtcaagatctcagtaacactgggttgataaacagcaacatatttctaagaaacttctttactattaacaataagtgatttgtctttctttgaaaacagtgagacctatcacaatccatttttgtctcactaactgagtaatatcctttgttacttaggtactttgcaaagattgtttcaggaaaacattcaagggaatggttctcagtagattaaaccatttagtataatcatcttgattccaaacacaaacacatcattcgacaagtcatcttaacaccaagtgtagatgttagggagttcacatgccagtaaagtggtattttgaatttcgtataaaactgttttaagttaatattcaaataatcatgtaaacacaataatttgtttatgagtagtagaaataaaaagcaatgtttgaaaatgacaatatcactttagataactctactgcaaactaagtttacttcactcaccaaaacgcagtatgtaaaaaatattaacatttaaagtacaaacagttctcgacttaagatattttgaccttataatagtgtaaggtgatactcatttagtagaaaccgtattttgagtacccatacatgcattctgtttttcactttcagtacagtattcaatcaattacatgagctagctttattataaaataggtttgtgtgaaatgattttgcccagctctaggatagtgttaagccagcacatttaaagtagggtaggctaagctatgttgtttcgaaggttaggtatattaaaggcatttttgacttgtgatattttcaacttatgatgggtttatagggacctaaccacacaagttgaggggcatttgtattagaaatcattcagaaagaatcaactaaaaaacttcctaaacaatggttgcattttggggttactaaacattcaaaggtagattaaatcctctgtgagtaagcgagcatttaataccacctgttattgagtcttcactgtctccaacccccctgcctgcttctcataggacttatcaatttgatgatttgtcccaaaaatgcattattgggtaggtggaatttttgtcccaacaataataggtatggaaatatcatgagttttagagtccattttcttgggtcctagcttcatctctcctatttactgtgagcaagccacataaattcacattttactcatcttgaatacttgtatcatatgattattggagcaactaaccatatacatataattttcagtaggattattaacatcatggtatacataaacaaaaagttcccaatcctcactatttctgaaacgaggatttccgtaagtttcctgtatcaatattcatctctccaaaataattgcactaaataattcaattgttaccaaagtcttgtgcaggctgctcatcagcatccagagacatagttcactgtacgtcatctgctctaatgatttaattcttcctattatcagataaaaacaaacaggaagccaggggcacaggagccattttagatctatgtaaaaccttccatggcacaatagctctgctcgattacttctgttaaagcaggcacattgcacaatagttatatataaatgtgttagctatatacagatttagaattcacttacacaatggaaaggtacatatatattgttacctccttcactgaaataatgttttgccactttgtcccagtatcatccttttttaaaaacttctaagctcattttaaatatagaatatgtttactgggtgtgtgtatatgtatgtgtgtgtgtgtgtgcgcgcacgcgcgtgtgtgtgtttgtgtgtacgtgttgaggacatgaattggcatacagagtgtaataggatagtaacacatgaataaatgctctgttttccctgtttgatgccaagaaggtagccaaaaccataatcaataaagaaatgaacaagtatccagaggaaaatcacccttcaaaaactttagttctgaaaatctagattcatgttaaggattgatatattgtcccaactgaacaggctattgggatatgggagttaagattcggggacagtggaaatttgcaatcagtcagattaaagagaggtttaatgagcttcctcaaacacagggaaagggatgaagttgtgaaggccaacatcctactccctttacagagtttccaaatgttgtgctgagacaacctacttaaatggctgtagaggccagataccaagcacagagcatcatcagcaaaaccttccgtgttcaagcaaggcagggcattgtggacaagctgtcctttatgtagtcatgtttacttggctattaagcatatcagctatgaccaaaatgcactgaaaaccaggacacttacagtattctggactctacctggccctttggaatggaagtgggaagaagtagaagaatgcaaaatgttacggagattgaatttctcaccagtcagattgttggggttactagttgctgcaggaacagattcaaccaatgtagagaaacaaggaaatatggcttattacaaactaggttatagaatcaaaattcatgtgcatttcaatagcatcatgaaattatggagttaggaacacaatgattacaattaaaatatcatgttctcaagaagaccaggtaacatcatggaaaagaatagaagtaaataagaaggagagattcagtagaaaaaaattcataaatatatgcatttttcaattcaattcagaaaatacattacataatgacaaaaatgggaatattttgtgtttatatgatttactatttataatgcccttttattatatgttttgttacaagtaggcaagaacatataagaaaaataagactcagagaatttcaattttatattcacctttcttttcaaataaattaaagtatggatataacgttttctcctaaggtagagagtagtgtgaagaagcctgctttatcaaaaaataacgtgctggtggggctgcggagaaaatggaacacttatacactgttggtgggagagtaaatgagttaaaccattgtggaagtcagtgtagtgattcctcaaagagctaaaaacagaactaccattcaacctagcaatcccattactgggcatgtacccagagaaatataaatcattctattataagacacgcatacatatgttcattgcagcactatttacaatagcaaagacgtggaatcaactcaaatgcccgtcaatgatagactggaccaagaaaatgtggtacatatacaccatggaatactatgtagccataagaaagaatgagatcatgtcctttgcagggacatggatggagttggaggccattatccttagcaaaatgatgcaggaacagaaaaccaagtactgcatgttctcacttataggtgggagctaaatgatgagaacacacggacacatagaggggaacaacacacactggagcttatcggaaggtggagggtgggaggagggagaggatcaggaaaaataattaatgggtactaggcctaatatctgggtgatgaaataatctgtacaaccaacccccgtgacacaagtttacctatataacaaacctgcacatgtacccctgaacttaaaataaaagttaaaaaaagaaaggctaccttactgactcaaaagtttagtgttaatttaccctacatcatgcttatcatgctggctaaaaggtaaattaaaaagaaatcttgcaagaagtatgtcatatcaatttattttatcacatgatattgcccaaagagggtgagtcctggatttttaatgtggacatatatgttgcggcaatgaagaggtaaatgaactattgtggcaggccaggtctcactaatgcaggcctccacaacaactgtttcagcactgactgagtggtaaagttacatattaaaagctgatagagccagcgcccttaaacaaaggctggacggtaacaaaagcccaccaagagttttgcccaggcctttcctgggccttgaagcatgacaagataatgaaggaattcttaacaggacccttttagaattaaaaaagctttattgggggtctgaagaaactccccaggactccacaaacaagtttactgggcatctgaaggaactcccccaaactccatgatttagccggagataagataagggtaatcatcccagcacctggacccatttagataaagtaaatttactgaggctccagaggaatgtcttcaggaatcagatcttagttacagatcagaagaagttaatcatttatgtctttagatggatacacacttacatgtagacatacagcgtagaaggtatataagctctggaaaactttatagttttgagttggtctggggataatttccaggtcttctccctgtaaccacttacagaaataaaaactctctccttttcccgttcatctgcatctcgttattgggccacaagaataagcagcccaatcctcagtttggtccaggaacactatcatatcatgggcttttgtgaagacattagacaaaactaattatgcatttctacttcatttaagtcaaacatgcatactatgttggaaaaaaatcagacagaagagtgagtatggaaataaagatgattactaaattcagtataggatcaaaaccatcatatcactcattgggagatagtttatctctctcaattgagctggcagtaaatattttttcccataaaattttttctcaaacacaaacatcaagcacattttatgacaaaattatttttggtcatgttttcaaaactgtacttccctttattaagccggcatggatgagcaagatttttataatgcgaatcatatttgtcatagagtatacacgaggctttttaaaggattataacatatcaataaattacatggaaagaatatttactctgaattaatcttatctagaaatggttttgtgtttatgtggagataaatattgttcagttatctctatataatagatgtgataaatcacattctagtagaattttttggaatcaaagttaatagaagacttattttaaaaagagatagggcttatttttaaaatggtaccaggaaagtggaaaatcagttagatttactgcaaagacacatttggcttcaaatgacgccacaacaacaaggatacatttaatcacatttatttcctttaaatatcccttccgtagctttacaaaataacaaggaaatattttgttgtctctctataatttacaaatattatataaatgtgtgtataaaaggcaatgaaaaattatcatctgtctgtgtggtaaagtagacacagatagacattaatacgactataaaaatgaatatgagttagatttattagtgaggcatttttatagttgtatgaatgtgtgtgtgcctgtgtctaatttaccacacagacagaatttttcattctcttttttctctttttaaagtcttcttcaacacaatttttccacccagtttttcttctgtttctacagttagcatagatttaatgatttgtactactgacctagtatatttattatatttatatagtgtactagtaataaacaatgagattatatagaagatatacattcctgcctttgatgggctcacattttagagctttcttcataaaggttaccagattccctctagctcagattactgccttctcagaccacccacactgagcccactcagttctaactccatttatcaattaaccaaaaactcccaaataactgtgtaggttccatgagttcaggagattccacttcaactaatctgtgtatcctacagggctagaattctgctgaaaggcatgcagcgatgcaataaattgccaaatgatatatatatcacaattatgtttatcttttggtttcaccaagtggcttaaactgaatcaactagcttcctctaaattcccatcttcttcaaaagtgtctaaaagaatgcagtcacttagctaagttttgacagaaaagaataagaaaagaggaaaaagattctttgcaagttctcaaaattagaagttagtgcacaggtatatatacattttacctttaaataagttttctcctctgtctttgtaaacttttatttctattcctgacacctaggatatgcttgataatagaatttctgtacttgaaagaatggtgactctcctgatcagttataacagacttagggagaacatttgtaatataaatgaaaagtgtgagttgagttagaggatgcaaatattttggaagaaaacaataaatgtgctcatatatgtgaatattttacagttttaagatatgggcattcataaggacagaaaaaaatataccgaattgctctgaggcagtgctaacaatatataaatagaggatggattggatatcaagctttgatttctatattaacaggtgagttgtgataaatgataatggaaaaggttaatgcacagagcgaagatctatttcaacttgcgggaatgaggatacacagtacttgtcatgtttacacaccttttaaaaattactctagttcaattcaaagattcagagtattgttacatttactatttcagaaaatttcttcacaattctgatttgtctgtatgtttgtttgaaaatatgtctcttgtctgcttcagaattccaaaacttaaaaatgtcaatgatgccagtatatacagcaattaaactatatataaccatcttataaatattcggagaattatgaataactttcctaaatatcctaggtttactttttatttattcttctatatttgtgttgttatattttatttcacttagctaaaaaaagttgaggatttaaaaaacgtttttaaaatacatgtttctgtttacgtctgtaatagaaatttgttaattattcagcaagtaaataaaatgaacttttattagttaaaattcagtaagttaaattaaagagtacatggcaacattctactaccaaataccacaaagaatagacgatattctaaaaatgtttgtcatagaaaagggagaacttttgagattggatctcctagtggattgttttggctccattatcatgaattttacaaaatcagacccatagagggagtaattcatagctattaagagtttcaggcattttagtagaaattttcacttttagtgactctttaaatcattacaataagaaacaaaatatccactatcaaaactatgccactcttaaagccttgggtttaagggccatattttattagctttatttttccattatctagatttgatgtctcaattaagcaatcaatatatacatatacaaacattcatgatggaaacataagaaaaccgactcaccaaacatttgattgatttacccaaatcgagaataataattaaaatgcaagtcttttaaactttgacatcccaataaacctccatatattgcattcctaatactagttttcaaggtaagaatatcttgctctgtgtccacctataatcatctagagtcacgctattgattaaaaattgagttgtatttgcaaattaagtaaatattaagagtatggattgaagcctgcacaaaaacaagatgaacttattgtctttaatcatttgaaatatgctctaaactatagtggctgaatacacccaaagcaattatattgcttttcttgaacttggtaaagaccaagagggacaaaaaaatgataattttcacaacaaaattccctcatatcttcttctgctgggtgacatattctagctacttgatggaagattgcagctataaactctgaggactcatgtcattaaagaaactcacattgtcaagaagaatcaaagatatacattttatataattaaatagtgtatctttgccatatcttctgctgcttactccttaaataagagtgaacataatatttccagatttgcacagctaaaataaaatgacactatgagagaaataaaacggatttttaagatacacaggtacatagtccattttgaaaatttcacaacttagatcttaaaagtaaagtaacaaaccattcttaccttagaaaattgtgcatttacccattttgtgaatgttttcttttgaacatcttctctttcatctaaaatgcaaaataaaaaaataaaagttaggaagcaactttaaatataattcatattttacaaccaaagtaactttccattatgatgtgttagtgtttttttacatttagtattacattcattgataaatggaattaaacatgagtgatgctggtttggggcatccaaattaaaattacttctgaaaaatggccaggcgcggtggctcacgcctgtgatcccaacagtttgggaggccagtgaggacggatcacttgaggccagtagtttgagaccagccaggccaacatggcgaaaccccatctctactgaaaatacaaaaattagccaggcatggtggcatgcacctgtaatcccagctacttgggaggctgaggcaggagaatcatttgaatccaggaggtggaggttgcagtgagccgagatcatggcactgcactccagcgtgggcgacagagcaagatcccgcctcagatttgtaatatctgaaaaacaattaatatgaccaaacccatagtcgttcaaatactgtatgattataaaaaaatagtctcctctgaataacagtatttattcgccagttatgaatagatactccagtataattaaaagaaactctcagctgtcatttactccgaaaaactatttcggagcctttccccatgccatccacccaaccatggagaaatgattattccttcctttgcagcatctacatactctaacatgggcctgatctcactatggaagaggtttcctgatgagcaggagcatggtttagttatctttgcttcccagaacttagcacactgtctgaacaaattaagagctcagaaaatacatctgacaaatacgtgcatgctttaaggaaggggagattctacaactctaaaatttctaggacctcttttcatctaaaagtcagaacatttcaaataaaaatgcaaatgatactcttcatgccttacatataaatactcaaagaaaaaagtccccaaagatttatactaagggattagggagaaaaattattaaaaaacagcttcactgaattcatgcttctacaaatgatctttttgcccctaaactggaaattagtattaagtcaaatggacagaaaaatcatcaatcttgatatattaaaatgtttttctccaagcaaaagactatttttttaattattgtaaatataatcatattagttaatgttcagtaaatgaatgcatctgagagatatttaaaattgataaattttatattttatctacttggattaaaagaaccgttattaaaatgccctttacaaagtaatcatatttgctctcatatatttttcagtagtaaatctccgttgcttctcttaaaaacataaggaatcactttcgcataacaaatatatgcatgcaccaaaaatatctgtttatctttaaatcacaatactaatctataagtagattcctttagtcaatatgagaaataacagtgaataaataaatttcaaactgtcatcttaggtgagaaattttatttagcattacaaaatacatttttcttatttaattatgttattcacacaagcttctatatgtatgttcaatatcaacattattcatatggtatatgataaatcttagctacaatatggaagtatttcctttgttgacaagggtgaataaataaaaacagatagtaatagttttcaaacctattctagcctccttcaaatctttactttcataaaattaatactagcccttccaaaataattttaaaaagaaatggaacatttcaaatggtcaaaattaaaccatcttcatagactttatggaggaagattggtcaacgcatcatttatcagtagtatatacatatattcctaaaagtaaatgaccttatttgcaattccacttatatttcctacatgtgcatgcgtactttctgtcagaaagcagagagtaaatgagtcagttgaaagcatacattcagatgtctttgaaacatacccaaaaccctctgccaaaagctcaatatgaggtcttttgaagtgatttaatctagaggcttttaagtgaaaaatacgtagtagaataaaatttttattcttttcaattatatggacaaggagtaatttttaggtaagcatcgaaggcagcacgaaaaccttgacattatgtgcaaagtgttacttatttactgtgtaaataacactaaatgtgagcttcaacatataaacatctttgctagttgtcctctctcacctctacgtctttaatacaagaaaaatgtcttcaatgaattattgtcttattttggtatagtagcatatattttcttcaacataataattattaatacaattaattgtattattattataaaatacataacaattcttagtgccttactattcataagtttgttttaattatgtcttctcaatctgtatgtaatttactactttatacataaacacaagctgagaaggaataaagctattaagtgacagaaatgaacttgatacagattttctgaatcaaagtccatggcttttcacattgaccagatatctatcatttacattataattgcataattaacaatacagaataccataagataatcagagtcacaaaaggtgaacatattaacgcaaatgcaaaacaaccatgaaatcagagcttctattttgaacaactcaaggaggttccatgtatgttgtaacctatgtgaatagcgtcctggaatttggcaatgcataacttatttgtctgtatgaactgatctagaactgaataatgagccttctttaatggtgctggatgatatggttgttaatacttcaaataataatgcttttacatttactaattgatatttggtatttcaattttcgtcttatatatcattatggaaacattttaacatccaaaaatcaatcaaaatttttgtgtccacacttttaaattccccataaatacatatttcttataaccaaaataatattctttctttttcacttattttatcataaatctcatataagctgctctttccttttgtttgctattagagactaaatcacaataaacatgctcatgcactcacttcttttttgtttttataattgtcttcgaaaaaattatcagttcaacattatgaaaacctttatgacttttgctaaatatctttataatactttccaagtgatcacacccacttctactggtagcagaaagaatgaggttgggaattatcatctcagccgcaggtatgtcattcataggagtttcgttgctttagtcttttacggtattgctgctttgtttagatgtaaggagatccttgatgtttgctttaatcataattaatttgattactaatgaagtagaagatgtttcatgcatttatttattctgtatgttcctatttttgtcaaaatacttgtttacatcctggctcatttatctattgagcatttaatattttaaaattaattggaatgagataattatatattggtaattcttaaacatttcaagtcatgggctccatttgattatctgatgaaaataatgaaccttctctatagaaaaatgtctacacatacatatttgcatatagtttcatagagttcactgacctccttgcagaaaactcctataaccataaaatccaagttaacgatcaaaattaagctactcacttttagtcagtgaatggacatattttcccaagtggtcatatgccttttaatttttattttagtatgctaaaattttatacgtatttacttgaattgatatatttttattgctatttgtcatattgcttaaaagttgactattttaagctgtatacccttagttaacctaaagccaccatacatacacatcacacatatataaattgttctagaaactattttgatacgttaacatgatgtctatttctgtagtcacatagtctatagtaaaacatattaatgtgcaatcagcaacaaagcaaatgagaaaagaataaagtgatagctgttttattacaaaatgattatatgctcctgtttagtcatttcaagcagcacatattctatttcatttcctttagggtttgtttataactgattttattttactaataaaaacatgcatgtgcatattaataagagaggcaaagaagaaaatctctcttaggaaaatttacttgaaaactgttccctggagatgtcaagaagtgaagaaccactacttcataaattgcaaaaactgaccaacgttttattttattctctctacggggaaatcccatataaaattagctttctaacatgacataaaaattgtatttcctctcagtaatctttaaccccttctaataaagttatttttattcagtatatgtggcctttcatattttttaagattagtacaatgaacttttaccctgttattaacttttatattccttagtccctcaggaatataaatgtgggatatattaaattgcaatattcttgattcacaagagcaagttactgcagaagaatgatactgggcaaactgagggaacattaaatctgtggaactggcttccagtggctttgcaggacttattagaattgtggccttaaaattgccaagccttagcgtctttaactgtgaaatgagaatattaattgctctttaactcatggagctattgacaggatataatgagatcatttactcgtgtaataatttataaaataaatatttacagaatgcttactatgacctggacattgcactagttactgaaaatataaacaagattcagtctgggagagctcttagcctagtagataatagacacatcatagataaatatgaaacattttgcataaacaaaaatatatataaatttaaagcgtattataggagcatggagaaaggaatatgtagccacatgggtgttagaaaagatattttggagaaggtaatgggtaggttgagttcagaaggatgagagaaagtaaagaaggaataaaggtaggaggaggataaagatgaatctcactgagcagacagtaaggacaaggacagagtgataagaaactgaaagtacacgctcattcattatgcaattctgttttgttgcactctaaaatgtgagaaagggagtggcatggaatgaaattgcaatgagagttaggagcgagatgctggagagcctccttaagacctcttctctgccatcagataaacaatgtaagtgaaagcatttaaaaactgggggaaaaaaaaaaacagaaaaacagttctataaacactaacaattattcccattacacaaagcaattaaccataatctgtacaagaaaataaaatttttttgacacaaggtctcgctctgttccccaggctggagtgcattggaaccatcacagctcactgtaacttcagacccctgggctcaagcaattctctcacctctgcctcctcagtagctaggactctaggcacacatcaccacatctgtctaatttttaattttttttcttttgtaaagatggggtctccccatgttgcccaggctggtctcaaactcctggactccatcaatccttctgtctcagcctcccaaagtgctaggactacaggcatgagccaccacattcggcctagaaaaacattttttaaatgatatttccttgggggctagttaatatgttaattgaagatcttcatccctaatgtgacacagaaaatgtatctttaaaaggggaagggaatattaaagttgataccagtttagaaactcacgtagtgaagaaatgcaatgggatgagttaatttcacttaaagaaagaactatgaagccgggcgcagtggctcacgcctgtaatcccagcactttgggaggccgaggtgggcggatcatgaggtcaggagatcaagaccatcctggctaacacggtgaaaccccgtctctactaaaaatacaaaaaattagccgggcgtggtggcgggcgcctgtagtcccagctactggggcgtgaacctgggaggcgcaacttgcagtgagccaagatcgtgccactgcgctccggcctgggggacagaggagactccgtctcaaaaaaaaaaaaaaaaaaaaaaaaaaaaaaaaaagaaagaaaagaaaataaagaactatgaagtaatatgggagagcaattaagttcagtctattctctgcttccatcaaacatgagaaaaaaatgaaaaatatggaagattaatgataaacattagataaggttatgtgatattttggagcattataaaggaaggaaacaaatttaggacatatttagaaagtggatttactgtgccattaatattacaaaatggcagtgcagagtggaggaggctgcaatggaaaatggtatgaaaaatgctttctattaaatctgagtaatagtctttgattatgggatttttctaccgcctgaggtgacgttagtggtcagcttacaatgaggaggtctaaaataattaaacttctgcacgaagaacagaaaagctgttcatgtcaaagatatttctttatttcccattcgctttacagtcaatgtaatgcagtcttcactgctcatcatcctacaaaagttgttcttaataacatcacctacatcctttctcatttccaagagagtgactgtctggatcagagctgtaatcccagcacttagcatagaatgtgttacatagtagtgctcaataaaggtgttttaagttaacgaagaccagatttactttttagtcctcttctcatttttctcctctgcagatattaattctattaaactctggtaggcagaataatgcctcctcaaaaatggccacgtgctaatccctgacatctgtgaataaattatgttacatggcaaagtggaattattgcagatagaattagactttctaattagctaacttttgatagggagattatcccagattatctgagtgggcaggatttaatcacaggggtccttaaaaggggggaaatgttggcataaggggagaattagaaagcactatgagaaggacttggtccgaggtggctggttttgaagatgtacgaagaaggccgtgagccaaataacgtgggaattctctagaaaatggaaaaggcaaggagacagattctcccctggagcatccaaaagtacacagcccttctggcatcatgatttgagtccagtaagttccagtttggatttctgacctgcagaactgtctgagaataaatgtatataattttaagccactaaatttgtggtaattttatagcagcaataggaaactaataaattacatttcatatttaaggctattaagtgacaaatgtgtactgacacctactaggtggtagaaaaacaactgtgagaaaggcagtgtctctagcttttttccttctagcttagtgagagaagcagacacaacaaaagggtatgttgatacaaatatacagataagttgcctgatgaagaaactacagtcatgtgacaatcatatattaaggaaactaccttgaaaaatccagagcttccttgatgaagtgacatctcagctgagttttgaaagttaattaagagcagagagacaagtggtagaaaagagaactccagaaaatcaaaagagcaggtgaaagtgtcaggatgtgagagaaagagtatggtcctttcccagacctagagatggtggaggaggataaaaatggcagagatgaccctagaaaaagtgaaattatcatcaacctatttatgaagagcctgaaaatatagccagagggcagttcgaaatcaaagcagaattttaagtagggaaatagcaatgtcaggcttggcttttagaaataaatttcacagtgtagagaatatttggggataaactgtaaataagaagacacatgagctgattatacctataatccacgtgagaagtaagcatgacttgcattaatgaatggcagtggggctggaaaaggagtaggtgcattcaagatgtgtttacggggtagtattggtaagtactaattattaattatatgtggagttaggggagttggatcatggataatcaatgataaagctaaattccctgatggagaaactacagttctgttacaatcatatattaagagaactaacttgaaaaatccagagcttctctgatgaggttacaggctagattattcagaatggcatataagggccttcacaatttgactccagtgtactcctctaaacatattatcgattaggcctgttggcagtcacccatatcccaaaccttatatacatctaccaggtctgccttagtcacacaagccaaatttctccataaataaatcatatgctttcttgctttagtcctttgttcatgcactccctagaatgaggacactcactattaagatctaggtcgaatgtgagggttttcacaatcacacttatctccctggcataacttatcaatcaatccttctgatatatacatatgtgtaggcttttttctaattatgcatatgtgttacacacataaatactttaactgtatgtgtatggacacacagatactttaattgtgtgtgcattataatttataaagtgatttcaaatatctcatcttgcttacactcacacatacacacatacacacacacaaacagaaaattagtttgttgtcttccaataatgcagcccaaatcccactcattacctcctaaatgtgaccacacttagatgggagaattattatgtctttgcaactcctggcaccaaacatggtatactgaagcagaaataggtacttagtaagggtttgttgaataaatcaagtgactaatcaatactgtaattaaatctcagatctactaagtcctagaccaatgctttccccctgcacttcatcatactgctcaaactactctgttaattatagaccttctgtcaccaattcatttcctaaattatccattgagcacccattagacataaaactaactttcaatgacttctccccaaaatttagccttggaactgaaatattgctacttattttcatcactacaatgaataaaaaattaagagaaagaatatttcttgcaaacaatctgcctttatttctctaggtgaatttcactctgtaatatgatataattgccctttacttcatctttcatgactgtcatgcttctgacacaatgtaaaatgctatggatgacctgtctgttcctttgcctccactgcaaacgccacttctttctcaggtaggtcaattgcttttttattgtagggagttgttggactcagaaaccagattggaaagccatgtcagctcatattgaataaaagttctctcccattccctgccacttaatcacagaatttatgctccattagcaaattggagttatggtgagaacctaacataatcgcatagttgtatattcataaaaattgcaatgctctatacattggaaacatagcacaagtattgtagaaatatacttgtgaagaattaatcgaagttgcatgaagtaggacataatgacaatgagattgaagaaatgtattagagtggaagaatgatcagaactccaagagtatatgaaaaggtgttaagtggtctcagttggaaaaacagtgccatctggtagattgtgcaaacagttaattcttatcctcttaaaattgcatgtgttagatacaatgcaggccggggttacatcatacactcatttcagagtcaaataacctgagttccaactccagtttcacatctcattatctctgtggccttgagtaagttacttaacctctctgtgtctcattgcctctatttgtttcatggtaatagtaataaagatactgaattgtgaagactaaatgtgacacatgtatgacatattaatgctgagaaagagaaaaaaatagacaaaacctataaatctttacttccaaatatattacaacttcccgtgggtcttctgtataaatgacattatttcataaaatagacacgattgctacgtggcagccatgttaataattagtaggatttttatagtatttgtaaatatgcaaaaaattcaagtcttctcgatttgaaagataaaaacaaaatatgaaatgatattcacataaattatacctcctcatgctcaaaagaatgaagtaagtttttagtaataatggaaataatggatatttctgtggtgcattataatttataaagtgatttcaaatatctcatcttgtttaaacatgagtatgtgggtgtagacttgttaggagtaaaaataagttactattaattagtatgcagacttgaaatgtgctttggtagtgttcatgagaaagatgacttatttttgttaaagtaataaccatagactaattatgacagaataaatcaaaataaggtcaaggtctccagtgtaatttagaggtgaaattaactacttggatattgtagcagaactgctaactagatgcctgtttccatacagctgcctactcaatattacttttaaaagattcaaattctcccctgaaaatttaaaaaaatacattgttctgtggtgtatatttatctatttttatgggttgcaaaatacttctttgcaaaccaaaaggaaagcaaacagccaaatgtgcacgacacacaacagccatttccaaacatactgttaatgagatgctttagaaacagacaaatggtcaaacacagggcctggattataaggggatatttaaatcacaagatgtatttactcaacttacactatggagtaaaggttaataaaatggcatagtagatgaggataatgcctcatcccttatttcaccgagccatccctgagttcacctataactatagtgaacggattctgtggatgctgaagattcctcaccacaagcatccacatctctctgtttctttgtgttaaggctttcttcagtttaggagggcttggtaagcccatttgcagggcagtccagaagtgatagagatttagttctcccaggggcaaccctcaataaacgagggacagaagtctatgtattaaaaaggacaaaaaaaaaaaaaaacaatggaacaattgctaagcatgccctgtagggctcctcaattgttgcatgggatatgtaatccagaatggcccataggagcatcgttattgtctgctctctgtagtggaatttgggcccacatttcttggcttgatcatgcactagttatgcagtgttagaaaagactcataggccgggtgcagtctctcatgtctgtaatcccagcactttgggaggcccaggtggacgcagcatgaggtcaggagttcgagaccagcctgatcaacgcagtgaagccccgtctctactaaaaataaaaagattagccgggcgtggtggcggacacctgaaatcccagctacttgggaggctgacgcaggagaatcacttgaacctgggaggctgaggttgcagtgagccaagatcatgccactgcactccagccccgacaggagttcaagactccatctcaaaaacaaacaaacaaacaaacaaaacaaagaaagaaaagactcataagccacaccaaacccaagatttccagtctgaaaagaggaaataatcgtggtaaaaaaactcttagcttcactttgatgaggtatcctgtaaagcatcgaaagtagtcttaagcaaagacttagtacaaagtaagtgccaatagagatcagtattattattcctgactatatatttaattgcattagaacttcttgaacaagttggtagtttacattatttgctcatcggtttctttttcttcctcctttccacttgccatggttcaccatgggtggattacacatcccactcactgatgtggccttggtcatgtgacttgccttgaccagtggaacacagtcagatatgagagtgtgtcaattctgagctaggggcttaagaatcataaagtgttttcacttttcttggtccttcctccctttgtcaggggaagtacacgcctcaggtagcctctgttcctaaaaggagagatgcatagagctgacctgtactcaatacaaaattgaacctgacatgtgaataagaaataaatgtttgttcttataagtcattgagatttggatttgttttttacagagcattagcctataataaagctgactaatatagcaggtaaatagtaaatgtggcccatagaataaaattcaataatgatggaatgtatataacctcttcatttaaaaaagagagggttgtattccatcattaaatttaaaataagctgaagaatgggttttaaatgaagtattaaaagctttccaaaaattgccctttcagaatatattatcttttaaatcttggtctttctccttaccataccattcaaaatttaaacattaaaacaagcaggttgttctcatacatggccaagtattagcacagacagaaatcaatgtagaaaacaatttaagtggaaaataagttttaaggaaatgcagtgagttattgtaatagcaatggtcagtactgagcctgctcatttccaccttgtgccaaatactgaaagcacttaaaacagaaataaagtttcggagtaatcattcactccctgttcaccaaatacggaagtcttaagccagtgtttatgaaagatcaagccaaaaattataaataggaatgaaggccaaacatgttttcagcactgacgggaaactttgcagtcagtaaaagaacattagagtcagtcttttagaaaagggtttggaaaattattactgagaatacaaaagaaatcctgggagctaatcaaaagaggagacagttttgagagttaatcaggtgccaatgctaatagattatccaagtggcagagcaaagaaggtccagagtcacacaatcaatttttattcagcttgagttgctaatactgatgacaagtggttaacgactgcttcttccaagattcttaatgaaagacttctcttttctcaggtttattatgccactggattaaaaaaggtatttatttctgtactaagatcggtgacaggactacaccgagaacacgtccctcagtgtacattgccaatagatgagttttgtctatatcttgattgactaatcatttaatagatgtgagtgtaggttggcatgcaaattaagtaacttttggccaggcgcggtggctcacgcctgtaatcccggcactttgggaggccgaggtgggcggatcacaaggtcaggagatcgagaccctcctggcaaacacggtgaaaccccgtctctactaaaaatacaaaaaaaaaaaaaaactagccgggcgtggtggcgggcacctgtagtctcagctacttgggaggctgagacaggagaatggctgaacccgggaggcggagcttgcagtgagccgagatcgcgccactgcactccagcctgggcgacagagcgagactccgtctcaaaaaaaaaaagctctcatactagccttattgtttgcacttaggtatcactgagttgaacttgtagaggaaaatataacagaattacaaaagatttagacattgtagaaaaaatttggatttttattatataaaacaaacaatagattttgaggttttaagggaattttctgtttcgaaaaacagcattttaagtatagttttatttcatcttcataaattgtaaactttattttaaattctagtcattacaaaagactttaagtcaaatggcaaattgctttcctctatagccaatttaaaatgtttgaatggttatctatatatacatatgtattcaggttgtgttcatatacatattgttatatacatacataagcttcatacatatataacatataaagttcatatatgcatgtgtataattttatattctgatatgaatataaaattcatgaattgtagcacactgaaaacattagtttttgattagagaacattaaaatgattgtaaagtagaatctccagaatttccaaagtttgtaaattgaagacattcgaattttctaatttaaagatttgatcattccgagcgcctactaaacgaattataaagggaatggctttcctgaattacagtaatatggtagttttagctttgaacctgcctatctgggttcgaaaggtagttctgctacttattaacagtgtgcctctgtttcctcacctgtagaataatgataataatatcggtgtagctttgtcatgagctttggatgaatgttcccacttgaaccctggctctaacactaacttgctctatgggcttctgttaatcatttaattatgtggaatacaatttcctcaactttaaaacatagaatttggaaaagataatttctatgtgttccgccagttctaaaactctatcatctgcttctttattctaggtttttgtttgtttatttgtttctgcaggatgcagtttacagtccttgttggagtatgctctggaatcatacggcctggatttaaagtccagttttgccgcttactggctgagttttctcaatttatttacataacttttctttcctttagttttctcatctgtaaaataggtactaaaataataactatctcatagtgtcgttgtgaggactaaataagccattatctttatatggcatagaaagtgtctggccccaaatgagtaatcaacattgttattcctatcctgaaatctatgggctttcaatacgactatggaataaacccctaaaattgtgggcaaaattttatgagtgtgtatatatgagagtccacagtcatcagcagattctaaaagggctccatggtttgaaaaatgttggatgaaaaatatagacattattctggctcttatggatattaatgatctctgttttacttttttctggaacagtggcattaacagcaatagacctgtttttattatttttctttactttgcttttttttacatgtttatttaagagatctgctcttcatctctgtcaccattgtaccattctttttatggatatacacacagtaattggcactgaaagaggtataattatatacactgcagctatgccagagaaagccagggctccttatctggcctagggaataaataatgggttttcttcatattctcttagatattactcttcagccacctaggattgggcactatttttttgttgttgttagtttcttgtgcttccatatacacagatgcagtttcttgtcacccattatattgcaatgccctttctgaaaagagcccagcctttttctgtaatgtactttgacagtaagtattgacataatgtaatacagtaattggaactcagaaagatttgtttgctacctgactgcttaagatattttaatgccttaatcggacacatatttttaatgcacatttttctttagttagagcagcccatgtcatgaaggaaccactcaaatgtggaattgatggttttcacaggatataaaaaacatcatgccatacaagaaacaaatcactcctttctgcatagatacagtgaattcacagcttggaaaccagtattttcaaagcgtggtatgaaagtgtctgagaataaactctcagcagagatcagtagaaataaccagtaaccgctaaaagaggaacattattgattggcaaagtaatccaaaaaagagaaaagatgtgtgtgaacttaatactaaatttagacaagtattcattgattaggaaatcaaaattcaagataaagaaacatcttcagagattaaaagtagtctttcattgtttgagtaacctagctgaggagtcaaactaaaaccaatagattgtaattagtatgatgctttaggataaagttgaataaagagagcgagagagagacagagagacagatgcattatttaccctgatgtttatacaatgccaaggtcaattaatttataaattaaatttatgtttattagccaaattttagaaactagagaaaaagtgagtattaaaagctttaggatttaaagtttgatatatttcctttgcattttccttgcataattgtaattgcattgcacaagtagttagacaccttactttcttcatttaaaataacaggttttccaatgttgttcaaacacaatttaaatatctagaagcattgtcttctttgttcccataaaaattaccgttctgcttttttttggaaccttgaaaaatggtctcataatttttgctattaaaatagtcttgcaattactatcaatatagataaagcctccacccaaatgtgggattattaccttagaaaagagtctcaaaaattataatggatttaggtgaaaaatcatctccgtaagttttggtacatattttcaaattacttctcaaaaattccatattaaaccacattcctacctgtaatggatgaaaaggtctataacgttgcattgtaacctacattgaatacattaaatagaaatgtaattcatatgtaattcaatgtaattcacatatatgtctgtgtatgtctatctaaacatgaatgcatgtgtgtgtatatatatatatacatacatatacatatacacatacatacgtatgtatttaaagaatttagacttgggtcttagaatcaggctctccctgaatccttcaactgcgagatataaatataagggaatgttggcaatcatggtctgctacatgaggaacagcggaagccaatctgcaataaaaaagatagtttagagagaaggagatgtgacagagagtcctggaaggttttgattgcattttctgaggtgtactgcaatttgccctaacctgccttgagaaacattttaatccttagaataaacgtatcctttggaataaattccacatttgataaagatagttcaaatttggtataagttatttgtagccaagtgtcctaattaatactcaagtaataagtagtttactgcttaacagtagaattagttctatttcatataatttttccatctctcattcagatgggaagttgctctccttcctcttgtaaggtcatgatgctctatatctgcaaactcaagggagaaaaagtctcttaacttgaaactatacaggaaaaaaaaaaaaccctgatgtcatttctagtacttaattggtatttatctgccataaacacatgaagctgttttggtttgttcagttacccttgtctgcatagggccatttaaacccaaattggaattgtctctgggttactatcagtgataacaagaactttcaattcatgccaattataggaattcacaaacacagataggggtgaccaaggaatccaaccagaactttctgtttagtttcattagactcagacttaatgagaaaaaaaaatcattagcactgaaaaacttgtaagtcttgtttagtttcttgctgaaatttaaataatactgattgtgtctgtgatggaaactggtaaagaataaaatgaatatttaatttagtaaggtatacaaaacaaaacatgagagggagcatagctattcctaaatggaaaaataaattggtatactacaataggaagtatgatttccttttaatatgtttgttttatagaagttactaattgcagaaaccattttgatttaacatcatcaataaaatcaatgtgtgaacaatatcattacattcgaaagatgacatgtctaacaaaatggcactatcaatatatatgtatttaaagacagtctccctttaactttgctagacaccaaaagtttaaatgcacaatgccaagggcagttaagtgtcaaaatacaaatgtatcttaatattttatttaaggcttctattgttaaaaataatgcatctaacataataaagagggtatttgaaatttcatatttcaatatccccatggtttgccatagaagacaaatataaatacatgcatgaaattgtgattttattttcttggttactttttggttacagctcatcactttgcattagtgcatacctccaaacctccaataatctcatatgcatcattataaggagatgaaagggattaagaaataagtttaagtcagtgcatagaatattaaaagttcctttgcatctaatatgaatggaagtgattactattaatataaactcaataataaaataagcaaatgcctgcttttattttctcctaattaacaagtttaatcctttgcacttaatgttagttgtttgccccggagcccggcattggtagacatctcactgctcatgggccattcttgtcaccttgactcccagctcaactttgggatggatgtttcaaaccacctgcctcgatgtgttcaaactttgtgtgagagcatttttgaaggaatgtaattgagtatgaattatgtgacagtagatatgtgaattttgactgaaaagttttgtaaaacttgagaaatgaaccttttggctgggcacggtgactcacatctgtaatcccagcactctaggagctgaggtgggtgaatcacttgaggtcaggagttcgagaccagcttggccaacatggcgaaaccccgtctctactaaaaaacacaaaaattagccgggcatggtggcatgcacctgtaatcccagctactcgcaagtctcaggcaggagaatcgcatgaacccaggaggcagaagttgcagtgagccaagatcgcgtcactgcactccagcctgggtgacagagcgaggcttcgtctcaaaaaagaaaaaaaagaaaaatgaaattttttcttcaattttatagtaaatgaagaaaacatttcatttctccgaagactattttgattgacacccgtagcctatgggggtttcatattccctcttttccgttgttggagatatcatggtttaaatttttaggaagtatctcaatcattcataaaagtgtgagtattctaagttacttcaatgagatacaaaattttggagccctgcttccatgtttcaacttcaaaagtagaagtcagttcgaactccctggtgactgcacttgagaataaactatcagtcaataccacactccttatcttttctttttccttcctacgcccaccccaccccaccccaccaaacaaacaaacaaaacaaaaaggccaggacagcaggttctacacttttgaatgcaattttggacagtgtgccaaatctcagtttcaacatcacaaattaggtttcacaaatggattctgaatatacaaaatgcttttgagtcaccttttttcttcacctttaaattaaaagctctgaaatacaatgaagtgttttcttcagcttttcatgacttttcccattgggtgattcacagataacaggtcctcaatacatttttattaaattcaatttttaaaatatcacttatctactacggcctttctctaataaaaataagtattattcattgtttccatctaaagtaagggtaactgtaatgattaacatgtcgaatgtggatatcccaagagggtaaaatacttacgctttccatcataatcaagttcctcttctgcttaggatgtaaaaatgctatataagaacgttgctccacccaatgagaaaaagcagggtgatctataaaaacgtattattttttgagccatttatatagctgtggccacaaggcaacgaggtgagccaaagtacttcaatctcctccaaggagagactggatacatgaaaggtttacctttggcagggaactggaggaagaagtagtcatcgtaggagcaggaaaaagaaaatagctccaattgtaaggcattcttaaaagtcaggtgtgggctggtatgacatttcagcatccttggaaatgcagaccgaaggagtctgcactcattctggaattcttttccacaaacttctattgggaacttgcaaaaaagtaaggcgtaggacaagagataggaagaagctcccctcagtgacacacaaacatgaagtcaaacccattttccagaccctcctcttctaaaaggcgtaagatttaaggaaagatactaaactgaaggaaagatactaaactctaccacccatgggacccgcctgttcagaggggttggggaaggtagaagccactgagagagggtcaagataccctctttggaagagcagtatgataacctctttggcccaggattctgcaccaataaaaacagaatgatctgttaccactaggggagagacaggcatataaggcttgctgaaaactgaggatggaacaagaagatagaaatccctttaggaccgcagacactattacattaagcacgggatagcagcagcccatcagtggaggtctttgaagactgtagtgttctgaaggttgctacagcaacaacaacccccgcccctccaaaccagctcaatactaacaccactgactcaaaccccatactagcagtatgacagaaaaaaagctatacctatttccaagattaaacatatttacctcattctctatttttcttctatacatgacatctaacattcactaaaaagaaaatgagacttgcaaaaaataaataaaactaagcaaaatacacccattatcaagaagtaaagccatcaacataaccagactaagagataacctatatgcttgaactaacagacaaggactttaaaatatctctgactgataagataaggaatagattcatctagatactaaagaaaacatccaaaactttcacaaacagatgggatgtttcagcacagtgatggaatctgtaaaatgatgcaatggaattgctaacaataagcaataatcaactcaaaatgttaatgtagcaattgcaaaattatttctattataaaaaatgttaaattacaaagagaataacagtaccttaaaatgacacataatttaaaatactacagatgttaatattggaaaaattgtttaccaatgttcacacctgagtactcaatcctttgatggaaggtatgacactataatgatttattataaaaactccttaagtggccgcgcagcctgcgcatgcgcgccggcgaccaagcctaaatagctaccgcctctgcgcgtcgccctccacggttaccccggctttccgcccctccttctcgcggggctcgagggaccatggccgatcctcgcgtgagacagatcaagatcaagaccggtgtggtgaagcggttggtcaaataaaaagtgatgtatgaaaaagaggcaaaacaacaagaagaaaagattgaaaaaatgagagctgaagatggtgaaaattatgacatcaaaaagcaggcagagatcctacaagaatcccggatgatgatcccagattgccagcgcaggttggaagccgcatatttggatcttcaacagatattagaaagtgaaaaagacttggaagaagctgaggaatataaagaagcacgtttagtactggattcagtgaagttagaagcctgaaacttttctcgtatggggtggtttttgcattaaatcctggggtccattttacaatccattatttttgaccactgcggtgtgttcaagtagtatgagaatgtgattgtttttatctggttacatatatatttctttgtctaatttaatatgtcaaataaatgagttcatctaaaaaaaaaatccatacgtgatgtgtggtttatatttgtaactgcctatatgatatatattcttaccccaaccccatcccatcatatagataagaaaatgctacttatgtgctcaggtttacacaactcttagatgtctctgactacaaagtctttgttctttttaatgtacctctatgcctctcatactttaaaattgaaataaattaatctactgctccaaatgatcaattttccatggaaaaaaaagagaacttttgtaattgtaacaacctctgctatatgactaaacactgagccatgaggtgggctgccaggtaaattggaaggcttcatctaaaaagtacaagactgtgaggcatattcccttctcaacagcctaggatgattggatctacccattctgtcacattttcaatatataattcctgttcaaactttctattaatatatcatttcaagtttcattgatagtcctaaaatgcaacacaaaagacgagcagatgatttcagccattccaatttgcagccttttgtagaggggcatcaatagattttactgtacttgcataaagccctagttgttcttttcctattctatcatttctggattggcgaatgggataaaatgttcaggaaagaaaaaacaaatctcaacacaaacgtgaatgtcattgaaagctaaaaaagtaaacaaagttaatgatcacacccgtaagtgctactgatttttcattgaactcagaggagaaagttactggattcccaaaagtaagtgaagggtatatgtttgctaaatgcattcacagcctgttgctctaattatttgaggttttttatgtgttgttgttttagctgttgtttgtgttttttattctttctgcatttttcttctactgtacagttgttattcatgctatgagttatctaaagtttacattaataatcaaattccttgcaccatcccaactctgaaacacacaacttggatggagattaagactcattcaggactcaggcagacatccttagtacccagaaccacaacacagcacacacgaatgcatggttctataattattttatggagcatctatgaatttgctatgcaccggaccctgggaagtcaatgtacagtggtcaacaaaaacaattcaattgtattaatatttagaagccacaaaatgcaaatatattcttttttaatttgaagcttgttattcttctgcacaatctatagctcctattagaatcattaaagtacattcagcagcagtaacaaacgaacagggaaaatgtgaacatgacaaaaggctgccagagtaacacgggtgacaaatgtgggaacattttagaattcccaatttcccactctaataaaataatatgaacaaaaaggctttttttagtagcttcaactgaaactatcacctgatctatttcttaaaatcctcacgaaggtttcactgaaccattagaggtttgggcagtcaaacaaattaaacatgaaccaatctttttagaatgactactgaagtgctcagtatttccagccttccagttaccacagtgaaagaaacaaacaggtacttgtcaggtttataagggaatgatctattttctgcccttttttgcctactctttaaggaaaacacacacacatatgcatgcaagcatacacgcatgcacaagcagaacacaaatttagaagctatagagaaaataaatagaaaacaaagaagttttgacaaaaccaaactgtctttacttttagattataaaaacaatcaactcttttttttattattatactttaggttttagggtacatgtgcacaacgtgcaggtttattacatatgtatacatgtgccatgttggtgtgctgcacccattaactcgtcatttaacattaggtatatctcctaatgctatccctcccccctccccccaccccacaacaggccccggtgtgtgagggaattagaattttgtaattcatttgggtagaggagcaaaaggtatatattaggctcaacttttcagtcggtgatgagagacaaatggcctgccatccctgccctctctcacctaccccagttaatctaaatctgcaaaacgaaaggagcttccactaggccagaggggctgcaggatgggaaaacaatcagaatggaacactttcatgggcgttcctacagaccaatttgcttccagtcagcccatttaatttcatatttatgattgtttaaaagagagagcccaggcgcagtggctcatgcctgtaatcccagtactttgggaagccgaggcaggtggatcacttgaggtcaggagttcaagaccagcctggccaacgtggtgaaaccccgtctctactaaaaatacaaaaattagccgggcgtggtggtgcatgcctgtaatcccagctactagggaggcttaggcaggagaatcacttgaacccgggaggaggaggttgcagtgagctgagatcgcaccactgtactccagcctgggtgacagagcaagagtcagtctcaaaaagaaagcaaggagggaatgggacaattcataaaagcaagccccagcagttctagttaactgtgaactgaaccagtaagatgcacattgatttaacttcggaaataatttatgtgctggtttcttaaatgactgctacatattgccttcttacctgacgatggagtgcagaatatggggacaaaaataagagcaattccaaggaaatgctttatgcccgagtgctaattcagaaccatactgaaaaaggagatgcaagagaatgctcagcgtagattctaggccatccttaaacaatccagagctgaagagccgtattcagagataaatttattctgcgttcaatgtttcttgacctacttctcgtaaggaaaattctgcctgaataccagaaggaattcatttttcactttagcttgaaatttaccttaagataaaacacaatagttgtataaaaatatgccttatttggttatgcatataaagcagacccaagaggatttggggtaaaatatttcataagttgtactatgcatgaatataaaaaatgagaaacaaaaggatagttagtaaaaggctgttcagtcccaaataaaggagtaattgttgatatgctaaataaaaggggggtggggaaagtcctttttttacaagggaatgtgaggaagggaactcacatttgttgaggctgtattttgcatttaatcctcacaactaggctgagaacaaacattaggcattttatttcccatttacagattgtaaacctgaggcaataggattagttgcctgtgataacaattcacatgttgagaatcataatattataggcctccaccacctaacaatgccatcttcagaactacacacacacaggtgcgtacacacacacacacacacacacacaagtatttcgtgagattgtaaccacattcttaagttccatcctttgcaagtaaggtaagttaggcactgtttcctcactgccttagggttgtttataaatacagagctcttgaattacaaaatcaactcttgatttcactgacagaggtcaactgcttttagtgtaagtgaaccatgattctggcataaacagatatagaagaatcctgtttaaaagtttttacctgctctaggtgcctaccaagagaagaagagggggaagttgagagagttacagataagtgagagctagaagccgtgtgggggtgtggggagggtcctgaccctctgacacacacacacacaccttttcaaataagaggaacattataatgtcctcttagggaaccaaagtcctaaagaagagaaggaggttctggagctgctgaaaaatagtgcccaaccagagcaaagggactgggcatgtagattagcctcacaggggtctgagcatctcatcaggtttgtgataagcagctaacatgtgtcggtgcttgagaaggtcatggaagttaggaggagcaagctggcagtctttcaagggtgtggtaatcaggacacagacaccccaaatcctggaggcagaataggcagttcaactaagggcgggatgcaggtactggttcacttcagccaatgcctgcatgcaaagatcttcttccccacagaccacattggatgtcacatctctgtgtgtccttgacctagaatcagaagttggccctgatgccatgaagctaagtaatactcctgtgttattccaatcctagagtggaggctagagtcctaacaactcctgaatgtgaccggtagacctgaaaagtcactgaattttattaagatttcctgagaatggtatattaagaaacctgttaaattaaaagaggaaccaaaatagaaatttaatttagctatagaaaaattaataaaataccatttttagcccacttaaatttgtgtgatactgaaatttttttttcctgctacagatgtataatttagtgcaaaggtgtagggcccaaggcttcactgtgaggaatgtaaatgtgctccccaaaataatttatgattttgactaatgtctgcacaaaatactatagtccataacaggtttcaaatcttataacaactattaatactatcaacatgtagaaataagaaaactgaggcttagagtggttggactctatccattgattgcccaggataacatcaagtgactgactgggggctcaaaattgttctcctgattgtaaatatcaatcctgtttcctatacttgtccatatacttcctgatgcctatttggtgctcaataacttttagattgagtaaaagaatgaacaaaaacatgtatttatttagtgcccggaaggggcatagcaaataattgatatcctttcctatctcacatagcattcagtacagcaaagtaagcaaaattgaggagggaattttaataatgttgaacatctacaaattgctagacactgagatttttatgcactttttaagtttaatcttcgtgttaatccacattacatatgaggaaatggagagagaatatagtttgtcaaggtaatggccatagtccatataatttgagtgcttactatgtgccacctactaaacactttaaacacatgaacatacttcattttcacagaccttgtaagagaggtacttctcttgaccctattgtatggataggaaacaaagcttagcgaggttaagtaactgcccaagttcatatagctactttgcagtagatgagcacaaattgaaactcatgcttctctaactccattattaacccaatagcaggtgctgaaaatcactgatcgtgttgctgacaaaggagagtaaacaatagccacataataatactatctaagggaacattactgatgtacctagattttttaaactttcttttatttatgaaaataaaaatgaatatattcgattgtattttcattcttccctctgtttgtgccactttaaacactggtgcctcccttctctttgacccaaatactcaaaacaggtcacacatttaaatatggcaagccctccagccctgcaaatgatggactataaaatttgtttgtactactggcgatttttttttaaaaaagcttatgcacacctactttcatatttttaggttggacagtaccttagaaataaaaacaaaaattaaaacagatctttatcttttaaaaaatctattttccaaaaggaaacaaatgaattatttttgtcttattattaccatatagcttaaaaatcaattacctgaaatcattatcattcaaatctttaaaacaaggcacttaaatgtttaatcttttttaaaaacttagccaatgcaaaactgctttcctccaaaacgccctcagaattacctgcttctcctgcactcttagtatccccaagttattggcagtgaataaaagtgtaaaggaaatgaatcttgcaattctctgtgaatttcattccaaaaaagaattttaggcattttgatgaagcgatgtagggattagttttaaatagggatctctgatttgtgtattattttcacaatttgtaaacttactttcttccaaaagtgatttgaaataaatattctgaaacactgaagatcaatggaagctaagaattagaaatgcttatacaaatctattaaacctaactgtatatatgcatataatatttttgttaagaaacatagaattctttagaataattcaattttatataattatggatacagacacatagattcacattgtaatgtttattcagattttgtgtttatttgttgattgttcaggcaaacggaaactgcatttggtgtcaacagttgcatttctttatatttatattagctggttagctgtgctggcagaactaaaggaaacctgtccatagagccttacgtagtcgtaactacaacacaatcatgtgtcacaaatttatagcacagcagacctttacactgaaaattgtttagagaaagaaaaattcgactgggagcggtggctcacacttgtaatcccagcactttgggaggccgaggcgggtggatcacctgaggtcaggagttcaagaccagcgtgcccaacatggtgaaatcccgtctctactaaaaatacaagaaaaattagctgggcatggtggcatgcacctgtagtcctagctattcgggaggctgagggcaggagaatcgcttgaacccgggaggtggaggttgcagtgagccgagatcatgctactgcactccagcctggctgacagagcgagactccccatctaaaaaaaaaaaaaaaaaaaaaaaaggagagagagagaaaggaaaacttgaaaaatgaatgagaactggtaaacaactgcagggaaagtaattaccacactcttcatatggcaaactaaagaaagggggcaccgcaagaaaagtattgccagagcttgaagggcagaatgtgtaattaggatgtgatatctggcagtggtgattccaatcattggggattaaaactgtatctcaacttgtgctctttctgttgctttagggccagtgtattcactcaatcttccatgatatctatatggactcactgaacctcagatcttaacttcagttgagcagaactagtcttctctctctcagaccaaggaaggcataacttgtgttccatgaagcctactgtgtcaagtctgccaaatgaaactttaaatatgtaggcattgtctacttagcctgaacactaaaaagagtcctttctacagttcccaaggatttgtttggttgcaatgtttctaaagtcagtacagaaacttccctgaaaatggagctccaaacttatcacgattttcatcctggaatgtatttaggtttgtatccctcgacgtgcaccactcaattgacgtcacatactttttacctgaaatttatttcagtttctcagaagactgtatatttccccagttacagattttactattccttaaatatggtggctgccactttcttaacctacagtattaatggcagaaatgcttagatttataaaaggcaaacatggggaaaagagagacaatattaaattcaagtctctcgaaaggaaaggaaaagataatgaaaaagcaatgtaaaaaatgagagataggtggggcaggtttaagatgccattgaatctctgcatagactgcctttttttttgctctaaatactaaacttgcctaaattaggccacctccctccagagaacaaaaggaaacttggccactatggaatagtaccaaagtgaatttttagaagctattattacccactcataatctatatttttgaaaattaatatatatgtatatttgtaattatcaatattaatacgaagcaatagggtcaacatgaacttggatacttctgttaagttcacttaaatattgaactaatctaatcacttctcattttttctttaaccaaatatgtaaattcaatataattgacttagttctcaaattggttcaataaagtgttcccacagtatttgcaaatatattcgtctttagaatattcctccttaacctttttaagtagaaattaaaatagaaatattaaaacgtgtatttaaaagtggtcttttctcttaacagacatttactttttcttacatgaattggtttagtttttttttccagcactgaaaccattccaaaaaaaactgtagaaaagagtgaatatttattctattggatgtttgttatgtttgcataataactaattagtgaattgaggccaactttgatcaaaatgtttgctctgaatagatatttgctaataaataattttttcatgtgataagtgtgtaataataagttctctatgctgccttgctttgatagaatattcagacaacatttataaatgactaattcaaggaattaaaaggtcttaagtgccccagaatgtagaaatggaataaacatgtggtagtggtgagggtgggctagaaatgattaaactagattttttttaaaaaaagaagcaaaaataccgctggaaaaaatgcacgcagaataaatgtcattatgaaatattctgaacgtgtgtacttgattttccttcatcacggcttcattttgagacgtccaggtcaaccactgtcaaccaatcaatctctagcctctttgagcagagatcaagggcaacagcagagccttaatgatttcaacctctagccttcaagggcacagattacagggactgaaagtaaatcagtccatcacaaggcacttcagcccatagcccatgacaaagcttgattagaatggaaaagtgttaagccatcaaaaacaagacacagctataaggaaagaggaaatataaggctaatgaattttagtgttcataacaagataaaaatgtgtttctcaatacctgtgtagccatttagaaatctaaagagcaagaagaaaattatgatagaacattctgagcaatttcttcctcttttctcaagagcagaattgagatagacttagatgtcaagtctacccattcttctaggccgttctcagacccattttcaaaaaaacaataaatccaaaagccaaaagcaataaacttgtttaaatactgaagttcacatggtgctcatgttttcagaaatccacttacactttacacccataatgtaagtaacgtaccctttaaatatttaactgctcactaatgtttttatttgcatatcatttctttttaaaactagataacacacacttttttagcagatatctttggatcttcactatctcaactgacttttctttttttttttttttttgagactgaatctccctctatcgcccaggctggagtgcagtgtttcaatctcggctcactgcaacctcctcctcctgggtccaagcgattcttctgcctcagcctcctaagtagctgggattagaggcacccaccaccacgcctggctaattgttgtatttttagtagagaaggggtttcatcacgttggctaggctggtctcaaactcctgtcttcaagtgatccactggcctctaactcccgaagtgctgggattacaggagtgagcccctgcgcctggcctcaaccgacttttttagaccacaggtaaatgttagttttacttaatgattgtaattattttgatatactctatatggaaaataaggaaagtattttttcccttttaaaataaggaaaatatataattacgctctatttttttttttttttttttgagacggagaccggctctgttccccaggctggaagttcagtggcacgatctcaactcactgcaacctccgcttcctgggttcaagcaactctcctgcctcagcctcccaagaagttgggactacaggcaagtgccaccacgcccagctaatttttgtatttttagtagagacggggttttaccatgttggccaggccagtctcgaactcctgacctcaggtgatctgcccgcctcggcctcccaaagtgctgggattacaagtgtgagtcaccgcgcccgacctaaatatcctttaaatctagtgtatctatgtgactataatgatgagaagtcaggatgccttccctacagctaaacaaagacttttctgaaatgtatatttggagacccagaatttcaccttatttgaatgcaaaacacttagaggaaataaatcttaatagaaatgatttttacagcatttcgaacacaagaattgtagtttaaaatattgttctttaaagctataagtaaaccaatgtttccaaactgttttttctagagcaaaatttcctagaaccaaaataatcttgaaattttagattaaacaaagcaaaacagattaaatcacctccaagtttctcagaatcttcaacatacaaatggctgttaatatctcaaaaaggaataaaaactgtttttccaaatatatacgagaatgactttttttctcccctagaattagctattgatgccaagctcagtgtttctcatatagtttaaaacacacggaagtaaatttgctgttcccttataaacatatcctgataatatggaaacatttattcaactaactaataacaaaacaggcaacaaattaaaactgattcaaaggggaattcaagggactgaacacacatagtcacagaaagaaaaagaagctagaacaagattgctaagttagaaacaaaacagattaacatcaaaaagtgcaataaaattatatattttgagggtgccagaaagatattacttgtctctctactgaacaaaaatgtgtacatttatgtaaaatttctcagaatctaagccctaatcaatagtaaatactatagggtgactatagtcaataataacttacttgtacatttttaaataactaagagtataactggattgtttgtaacacaaaggataaatgcttaaggtaatagatgccccatttattctgatgtgataactatgcattgtatgtctgtatcaaaatatctcatgtgcttccaaattatatgcacctactatgtacccacaaaaaaattatcttttaagttagtactaagttatacaaagacgcatgtccctaacaaattaaactatctgtcggtagatcttttagacaatactttttagtatgataataaaagaacatctacttgttcttttgccttatttccaagttttagagtttaacaagcttgaatgtgtcataattactcatttaattactcacgtaattacttaagtgtcaggcattgtgctggggactagggagatgatagggaactggataaatgcccatactttttagaagcttactaatgagggataatgacatgtaaacaggaaattgcaaagtggtttgatgtatgttaaaacatagttactgtgggccgggcgcggtggctcatgcctgtaatcccataactttgggaggctgaggcgggcggatcacgaggtcaggagttcgagaccagcctggccaatatggtgaaactccgtctctactaaaaaaatacaaaaattagccgggcatggtggcacgcacctgtagtcccagctactcgggaggctgagacagaagaatcgcttgaactcgggaggcggaggttgcagtgagccgagatcacaccactgcactccagcctgggtgacagagcaagactccatctcaaaaaaagaaaagaaagaaagaaaacaaaaagaaaaaaaaatagttactgtgggatgttgagatgacacacaagagatattcctcctgtaacgtcaattctaggtatgttccaaaaaggagacatcacctaaatgataaactggagttagctgggtaaaaagttgaggtgggagatgacatttccagaagaataacagaagctagaatagtgacttgtatgacatgattagtacgtacaatgtcgttcttgagggatgggtgggttcggtgggtgggaaggggtgaatgtaaagagatagtgcagaggccaattaatggagagattggtagagcatcttatagaattcagatttcacttttggggcaatgagaatttggcataatgagtagcattatctgacttacattttaggaaaactctttttgataacaattgggaaagtggatttgggaagtttgaagaagggaacgtggcaaataaagagacaaggaatcaggaggctattgtaatcactcaggtgaaaaggtggtataaactaaggtaacagccatggaaacagaatgatcacatcagttaattgttcaacttacatacaaaccacaaatccaatcaactaatatttcaaacgtgcaaaatatgtttggcaggggtttattacgaatgtttctataaattatgtctctatacacatatctatacatatatatacatacacacctatatgcctatatatatattccatagttttgtgaaagtgatggtataacaacaaaaaatatattctgtcatatccactgatcacaatagactttgtgcctctggttattttgcaaatcatttaacaattagttttcatttaaaggaagtttataagttaaagtaaacataagacaaatttattcttgaatgttaagccctcagcatcgaggaccatgaaaatactgattaattagtgtgacgaaggaaaacattgaattaagtcaactagttattcagttaaatttattttgaagaaaccgcagaaggttttctagggggaagatgacacaatcgaatatgctttttaaaacattctggctgcatgtggaaaactgaatcacaggggtgggggaaattgaacatctgttttaggggaactgcaacaatcctggcaaaacatgatggctgatgccaaggtaatgttagaacagtgatctcgagggagaatgcaagaatgatacccccaaacctgagaagtttggcacatgatgtctttcaatgagctagagaaggaggaagaattgcttagaaggcagtttttgatctcatatatactgattttgaattaactatgtgacatacatgagcataactgatgggcagggggataggtctctagctcaaaagaatgattttggttggatataaaaatctgagggtcatggttaagagttgttattgctatggattttgatgagatcaagaaaaatatgttgattgagcattaagattgaagctcaacgttaaaagagatttacgataggagagcaaccctccaagaaaatgataaagttgccctgagacaggaaaactagaatagtggaatatcttagaagccagggaagaagagtttttccaataggaaggaccgatcaacaatcaatactacagagtggtaagatgaggcctgatgtgacttgggccgtgacaaaatcaatttcagttgaaggatgtggaagcagccggattattggtgtttgaggtagctacgtgagtaaggaagtagatacaatgagcatagaaattgttaaagaagtttagcttcaggagtggaaaataacaagtcggtaggagattaaaaactaatagcagaatgtcctatttgttactacaggcaacactgtattgcaagttaaaataaattagttaaacctgacacaaatgcctgaacgcaagaaaaaaaattaaagggtttcttcaaccagacatttgtattttaagcattttattttggcaatcaattggggaaatgagatattttctcctcaaaggtaatgctgtagcagttataattgtattccaggacttgcgggctactattacaaatactcatggaaattaatgaatttttatccccctggctctggaggagtggctgaaagcaccgtgttttatagtctgacaaatttgggttctattcccagtatctctggataccagctatatgaccttgaacaaaatactgagcctctttcaaagcctcagttttctcatttgtaaacaaagcagtaacaatagctcttttatagaatcatggagaagaataaataaagtaatgaatgtattgtctactacactgtctctcaacctagagactatatcaaaatcccctgaagaacttcttataatacctctcccagaattcattatctagtaggtctccgcacagcccgagaatttacatttcttacaaatttccaggtgatattgcgggtctgaaacatactttgagaaccacagctttagcacatagacagtcacataacaaaaaccaatgaatgtaaatattagcatttctttgatggagacagccccaggctgcctacagcaagatgttcccttaggttcctgaaaatagaaagtcccgcatggtcctcatcaaagtccgctggattccttcaatacctcttcctcttttctcacatgggcattaacatccccactcctctaccttctaactcaattatctgacccctgcgctcttttttttttctttttcttttcttttttcttttcttttcgagacggagttttgctctctttgcccaggctggagtgtagtggcacgatctcggctcactgcaaccactgtctccagggttcaagcgattctcctgcctcagcctcccaagtagctgggactacaggcatgcgccaccatgcccggctaattttttgtatttttagtagagacggggttttaccatgtttgccaggctggtctctaactcctgacctcagatgatccgtctgcctcagcctcccaaagtgctgggattacaggtgtgagccaccgcgccccggcccccctgcgctttttataaattcattcattcattcgttcgttcattcattcaataaactctgctacagtattcagagactcttttctgccatatttgctttgatctagttaacacttaatgagtttatataccataatatcccttttacagtatcctgtaacgaatctctttatcatttctagcttatatcatggagtctgtgacagacaacaagattgcctctgaaccatgccctctactgatgtgggtattattatactgatgagatttcttctttctcgttctctgttatgaaaaagcaagctcatggcccacggggctcataaaaaatgtactaaaggctgagagcaatggcaactaatgatatacgtgtaagtacatattgatcaaattagagatgattttttttttcacagctcagtgatgtgtctaacaatagtattctgggaaattccatatatacataatataagccatggctttattcagatagaacaaatgccagataatattgttaggagcttctacaatagcaaaattcaaaatcacattatcattttaaaacacataaaatggctcactttttttttcttcagtgcctgtccatcttgtttagaaaagacttgattaaagccacatccactgataggcaatggaagttagattagatacttgtgtatccgatactgtttaaaagactggttctgttttataatttgaattaaatggtaactaatctttttttttgtaggagcttgggctaggcaaagtaaggaataaagaaataaagttacattttctatgactagaggtattttagaagaagttgaatgcgtacttaataaaatgtgtgttctatggagattctacgcatgcatagaaaactaggtgaaataaaaattctgcacatttctgtaagcaagtatcaaggaaaaagagttctgaacaattgcagcaccctgtaagtctccttcatgctctttcccaattcacactatattcccaccagcctctcaggaagaaactgctctgctgacctgaatcattatagataactttggccagttctcaaacttcatatagatggaatcacacagtaaatgttcatcttctagtcaacattgtgtttatgaagttcgttcatattcttccaagtagcaggtttttattactatataatattccacggatatacccaatttttgttttttgtttgttttttgtttttgtttttgagacaaagtctcgctctgtcacccaggctgaagtgcagtggcatgatctcagctcactacaacctctgcctcctgggttcaagcgattctcctgccttagcctcctgagtagctgggattacaggcgcctgccaccacacacggctaattttttgtatttttagtagagacagggtttcactatgttgaccaggctggtctctgactcctgatctcaagtgatccgccctcctgggcctcccaaagtgctaggattacaggcgtgagccacctcgcccagtctataccgcatttttaattctaattctgagggacacaagttatatcaggttctgctattatgcaaaatgttgctattaactaccttgtgcatgctattttggtggacttaatttctccccttttttgagacagggtctgactctgtcccaggcaggagtgtagtggtgcaatcacggctccctgcagcctcaacttcctgggctcaagccattctctcatctcagcctctggagtagctgggactacaggtgcatgccaccatgtcaggctaattttgattattattattttattttttttttttgtagagatgaggtcaaactatgttgcccaggatagtctaaaactcctggcttcaagtgaccctcccactttggcctcccaaagtgctgggattacaggcatgatccactacacctggcctactaatttcttttgaacacatacatatgagaggaattgctggctcataaggaaggcataaatttagatttagtagatattggcaaatattaatttacacttaaaccagcaatatttgagagctccagctgaggcaccaattctccccaatacttgatattgtcttattatattttaaccattcggatgcatatataggggtattcaaaattctttgattactaatgaagttaggcacctattcaaatgttttttaccatctttgtcctcttttatgaagtgcctgttcaaatattttgccaacttttaaaaaatgggttgtctttttattgatatgtatgagtttattatatattatggatacaagttttctaatcagatatacgtcttgtgaatatttttctcccagtccatgacttttcttttcactgttattagtgtattataatagatagaattcttagttttaatgaagctcaatttatcagtgtttgactttgtacttagtgcttgttcggtcctaattatgaaatctttgcttagcctgtatctcactcgtagattattttacttatgactggagattgcccaccagatgtaaccacttacacactaatggtcacagccatattctccttgactatgtttacttaatcaccattggcagagactatgtctcgtctaatattcttttatcccttattcagagactctcatattattgtgactgtaaattttcttagctaaaataatttccctctatctctctctgtctcactttctttctctctctctctctctctctccaactcccaaagatatataagtcggatttattgggcacagctaccaggaaaaggggttcaagaagggttacagagcaaatgaataatcttttgctagggctgaggagtccaactcatggcctcgatataatttttgagaatggaagctgggaatagaagatgtcagggaaccctggggttgttaatagtattgaaacaacctaccttgcagtacttttgagagagatataaaaccatcaccctgttctgaagctcgagccctagcttattattttccctttatcaattcacaaataaaagcaatgaatttcctacaaatacttcttcttggttttgaaggtatgttatagaatagaaaaagtcttacaaaggtgtattttcacatagtggttggtgatggtggacagaaatttttaaaaatcatatgtacccttcatttcatatttttataacaaaatgacaatttaatcaatgtattaaattttcaaaagaaaatgcaaatatctgttctacatagattgaagaccaagaatttctgccagtgatacccagccaagattagttttcagttagtctttttataccatctttcaaaacaaatggtaatgtgcgatccttatactgttaaagaaaaaattattcaatgtcacttgctgaatcacggtaaggcaggctttattcaagaccatctcaataggtatagggaccgtgaaaatagggtcttgcagtaggggagagagattgagctcaatttgaatacagcacaggcaaatgggaattttataaccaaggaacagggtaggggtcagtggatggaaaattattaagaggaagcatcatgggtaagggagactcctgctgaaaatagtccagtcatcccctggaggatggtggatgatgaggaacatgatcagatatccaggataatcaaataccaaggatgagtgttttctggctaaactgatctggcctgctaaaactaaattttaggagaatgtgcacagactgggctatgagaaggttgggaagcctgaataaattttggccgagcaaataatctttgtcagtactaacatagttaataaacagagagtaccccagtaattcatttatgaaaatgtgtttcaaaaaattccagtctcgaccaggcgtggtggctcacgcctgtaatcgctgcactttaggaggcagaggcaggtggatcacctgaggtctagagttcgagaccagcctgaccaacatagtgaaacccctttctctactaaaaatacaaaaaaaattagccgggcgtggtggcatgcacttgtaatcccagctaaccgggaggctgaagcaggagaatcgcttgaacctgggaggcagaggttgcagtgagccaagatcatgccactgcattccagcctgggcaataagagtgaaacttcatttcaaaaaaaaaaaaaaaaaaatccaatctctttgaaagttatgtatcacttgacaaaaacatttcctttgtgacgtaggttcagaaacattgggttaaactaagttaaacaatttttttaactacaaaacatttcagggttgagttgtgactcgctaaagaaggaaatgaaattatcacattttaacaatttgtttttcattcaacatcttacgggatcaatgttctttacaatttccatttggaaatgctgttctagactcatccgttatataaattatacatttaagaggatgttggttctaaatactttaacttgctatcaaggcagaaatttaaaagcaaatttgctcttgttacgttattctcttttatatccaagagaaaaagaatgttaagttgaaagttattttgctcagggacacttacaaagatatatacacattcagtagacacttgcatgacattacatttgaaattggatatatcttttagctttttatacacagatcatagtatgcagattttaagtggtggaaaatgaatcttttaacattcaaagtgatgagctttggagaaggctgttttaatctgttatactgcaggtgtaactcctggtacacttgtaggttagtagtgatattgtaggcatattcgatggatcaatatatatggagtacttgatattcagatattcagttctccccgatgccttaatctgggtgttgtttttgcagtggttaggaggaaggagaggaggtgccaagattcagacactgcagaagaggattatataagcagaaataattccatgatgcggttttgtacctgtttactacaaatcaaaggtggctgacacaactttgtccccaggaattctataatggttagacgatagctgtaaatacgctcctgtgttccttccagaggtgtgtgggaaaccctgagaatggggtgtgcatttgcccctagttaagggtcaacgaaatctaaggcagaattcagctacaggtttagagctatagtctctttagagttccaggtgtcccttttacttaaaactctttttttccctgacattttaaatataagtttccctattcactttgcaaagcttagttaatactgatatgtaacaaaaattattcgctacacttgagcatgtctcttctccataaagatccagctttagatagcaactcttctcatagatctgtaagtattgtgagaagataattaaaagtttgattattgtccatataaatagacggtaagaaaatacacattttcagtattgaataaagactttccttcttctcagcagaagttgattgtattccagaaaaggaaagaatccttcctttcataagggcaaattaaaatgcaggaactctgaatttgggagtctgtttttcaagatgaataatcatctttggcaataggattcaaatggcacaacagaaggaattgaattgatattgaataatctgaattcttgatccaacctctatttttgaatatgtacatttaagatcactttgtgcatttaactctcattatgcataattgcataactggacaacaatatttgtttcttcctggaattcaaggagtttattctacaatttttgtttttatttatttatctatttatttttgaaagatggagtctcgttctgttgcccaggctggagtgcagtggtgtgatcttggctcactgcaacctccacctcccgagttcaagcaattctcctgcctcagcctcccgagtagctgggatcacaggcgtgcgccactacgcctggctggtttttgtatttttagtagagatggggtttcaccacgttggccaggctggtcttgaactcctggcctccggtgatccacccgcctcggcctcccaaagtgctgggataacaggcgtgcgccattgagcctggctattctacaatttttagaaaggtagcaacttctttccccacatgacattaagttttttataatactaaatatgaagctttaatgcaccaaacatacttgcaatcatcaataaacatatgacatatctctactaacaagcagattggaaattatggcatcaattcaccatctgtgccacacagactctagttttgaaactcttatttgaaacagaaagttatatatgagcataagaggacactgcacatggagttcttctaactttatgtgtaaatttctacttaatagaatatatactgttataagctgcttcacttattgttaaacctatatacatatacattaataaaaagtcattaatattgacctacaaataatttgagttttaaaaaattattattactgtacttcatttttggaacaggaatcaaattataataaaactagtagcacagaaacagacaagattactttggttaccagagactctgccaaattttcaatgataatttacatatgaaaaaaatagaagaaaaagtagaaaatgttaccatggcagtaaaatatgcatgtatttgaggatgatattcaacaggacttacctgcaacaaatataaaaagggaagtggaaaaattcactaaatcccttaaaatgttaagtactgagggtggaaagtaagatagataataattataatttttcctagaatgagggtaaggctcgagttatgaaaacactaacaccgtcagagtaagtcttaagggagaaccacttctggaattccctggttttgctccccggctgatgtacagaacatatgtctctagaagaataatcaaaggcattacaaagaaccctctcactaattgctgatagttacagtacagtcctagacacccatagaggcagttctttgcccctactacacatcagaaccacctagagagccataaaatattacctaagcccataccccaccccagaccaactgaatcactatctctatgccggggcttgggcatatggttgaaaattgcagtcctagatgacctgctacaatacacacacacacaaacacattttcaacttcatgtactctcatactttccacttcacgcactagcacttgttccctgtaccttcctaagtccacttagaaaatcagattttacatttttaattttttcgtgtgtgcattttaatgaaagagtatcactaagataaaatgtgacagtaggcaaccaatttctttcttcacagagcattgaaaatagacataattgattgccttagattcatgcccatatatacatatatatgcacatatatacttcaaactcattttgatagggcacagtagtgatttcctggtgtaataacaatccgttcatttttcatgtaacattgtctatatgattttattatactttttatacatagaatgaaatatttgttaataaatgaagaactaagggcactcactctatagcaaaaatgccacctctactagtaagaaaaagaaataaacattttctattattgcggcaactttctaaaaggaaaaaaaaacacaggaagactatcacataatgaaatcctttaattgttacttctttctctatctcactctcttttgtttcatccaagaaaactatttaactattatatagtgatatgtaattagagtctttcaattaaaattgttaagctacagattgttgacaccaccgaatatacttgattaaaataagtatagatgtaaacaaatgtaaacagaattgcacttaaatgatattcattatttagttcatttatttaaaatgcattgatggccagacgcggtggctcatgcctgtaatcccaacactttgggaggctgaggtgggtggatcacctgaagtcaggagttcaagaccagtctggccaacatggcaaaaccccatctctactaaaaacacaaaaattagccgggcatggtggcaagtgcctgtagtcccagctacttgggagactgaggtgggagaattgcttgaacttcagaggcggaggttgcagtgagccaagatcgcgccactgcacttcagcctcggggtcagagagagacttcatctcagaaaaaaataataataaaataaaataaaataaaatgtatggaatggccaaccaccattctacgaagtaagaactgaaagtctaataagcaaaggtctctacttctcagaagctctgttggatgatacaggtttgtgtacaaatattacattaacatggaaaaagtgctaacatgcagtagaggaggcataaacttgctcgattaggtttggtggttggaggttttacaaaagagatgatgaggcaaattggtgtttacctacacttgacagcccccacccatagttagtataaaatgtaattataattttgtgtatacagtacttgaaaaattattacagccaatcacaatagtggatataaaaattccaagtctatttacaaggaaaacattctggccaaatatgaccataaatatttgtgcttacaatacctagaaatttcaaatgtttgatatgttaaatatttttatttgtagagttcttcactttcaaatatagattacttttaatgagatagaaacaattatcagtttgattcattaagggacaatatcactttacagaaatttacatgtatttattaacatgtgaagcactttagtagataaaaaggacatttttgtatcacttaaaacattaggatgaaattatgaaatgtacatgctgcctactggcaccaaagattataagccggtctcacaattggcttttcattatataaagaacacccattatatgcttggaattcctatgccagcaggcatacagcaaatgctggaagcccattgttcataactttacttcttgccaagcatttcagttatattttctttggttatataaagggccagagctattttaagtgaaagaggtagccatcctcatctcactatatgacagatgtcatattacaatgccctacataatagtatgcaagggcaatgctacctccttcgacctggtgtaaaattccttagaattacaactgtgtgtttagacaataaaaccgaaggatttgcctcaaatatcaaaactaagtgcaaatgggcaatgctatatagatgagcaggaaacatttctcactctcctctaagtgaatgctaatatgatttcatgaattgacacaactaaattttgctttataagaacatacatagccaaaggatttaaaaaaaaaaaaaaccaccttaaaacaagttacagagggttaaacggaagcaaaagtaggtagctaagtattaggaagggtggaataatgtctaggaaacgagagtaataaggccaggtgcagtggctcatgcctataatcctagcactttgggaggccgaggcgggcagatcacttgaggtcaggagttcaaaaccaacctggccaatgtgatgaaaccgcgtctctactaaaataaaaattagccaggcctggtggtgcgcgcctgtaatcccagctactcaggagggtgaggcatgagaatcgcttgaacctgggaggcagaggttgcagtgagacgagatcacaccactgcactccagcctggacaaaacagtgagactctgtcaaaaaaaaaaaaaaaaaggaaggaaggaaggaaaaagaaaagaaaaaaaggaaacaaaagtaatagactaatcttaggaagctggctggagtagaatggcatagagcccccaacggtaccagcaatgtggggtaggtaggactcagctcctagatcttcttatggtcctcaggacataagaagcacactaaaaggcctatagaggatagatgatgcccatttaaacctttaattctgcctaaagttctgccaggtttatgtacgggcatagtgcacataaagcatgcataagaatgcatattttttgccttgcctttagtttttccaggttttcatgatattaacaccaacgattatgtcagagttatgctttgttttttctcaatgggagaaatccaagcataggccccctaaagaatgaaatgtaaaacaatgactcctgcctgatacaaccagaaggaagattgacaatacaacatgaaaagtcacggagtaaattattttcatacaagtggagaaattattttcagggaattcgtagaccgacagctattcacaggccatcaaacacccataaggacctttgtcatccttcaatcacttcagtagagagagaacatgtatgaaagagacagaaaacacagttaaataagcaattcctgttcagtaagtgtctgcagggagtttttcagagtgtgtacggataacacgtatacctactcgatcctacaagtgcgtggttctgaacagaagcaaatttgaagtattaataacaatgaagatggaaatagggttgttgaaaattctgtatttaatgagtgaactcagcgactgcagacacaaagagtgtggattctccgaatgattataaaagccttaatagaaataaatgattactaattggaatgggacatgaaagaagataaccttgttacaaagattccaggcaaagaaagaagagatggttccaattacaataatcaaagaggtgattttcttagaatatggctaaggaaacacattttcattcatttgtttcattcatttttttagtgcagtgtttgggaactaacctcagtactagtgaacatatgatgttaattctttagcgaggccaggagcggtggctcacgcctgtaatcccagcactttgggaggccaaggcgggtggatcacctgagatcaggagttccagactagcctggccaacatggtgaaatcccatctctactaaaaatacaaaaaaaaattatccgggtgtggtgacgggcagctgtaatcccagctacttgggaagctgaggcaagagaatcgcttgaacccgagaggtggaggttgcagtgagccgagatcacaccactgcactccagcctgggcgacagagccagactctgtctcaaaaataagtaagtaaataaataaataataaaaataaaaattctttagtgagatgaactgttaatggttgattccataatactgattctcattataaattactgtaacttttagttgtcttaaatattaaacaaaataacaacaatagtgccaacaagtgctgctagtgctgaaaatttcttcagattgttagaggaacagtatttcagtacatatattttgttacaatttcgagaaagaattcaaaacccagaatgggaataacaaagaccttttagagttgtgtttctcaaagaaagaccccaggaatacatgacttgtaaagacctaccagaagaatatcatttagaatggggctttagaatctgcatttttaataagcattctaggggattctgctgtattctagagtttgggaaggactgcctagtagattgtaaggccaaggtagtgattaattgatctaggctagagtaaagctgtggctgaaatatttttctaagttctcccagtgagtctaacagccaggagaaagaacacctgtgcattggcagtgacagcggaggaggtattgtactttgccaaggaagtatgcacagaatcatttttatataggtaataactgtatatctaacaaaactctatttcatttcactcttaaattcagaaaaaaaatacatgtaattcaaaataaacgttatcactggatatggtagcaaaacaacagtgcgtagatatgtgcttatgtttccgtgtgagttctatctatgtgtgtgcttatatatgtgtacacacacatatacacaacacatacagtgagagaaagagaggcagtttataatcttccaacatttttggcttatgtcaacctgtaggttaaaaatctgactttgtgatgccaaagaggaaaggtataggaaggagcagagaaaataactcaaatatggtttacttaggtatgggaggtgaaagattatttgtggcatcattacagctttgtgaaacaattggcaaggttgtgcaaagtaccatcttgatcagtgaagctttttcccttaaggatggattacaagtgtgtaattcaaccttgacttgtagacctccatttcctctctagttatgtgaatgtgcaccatacaatacaaagttctatacctattactttaaaccagtaacgttttattgtacttaataatagtcttaggctatctaggtaatctctgtttataggtgtttacaaagtaatattattttatgtaaactaataaaaacgttggtgctaattgctttacacattgcttggaaaagcaagccatttttgcagttgagtagttgctcagcactattggccaatctatttctatagcttcttgtttttcatctccttcaacaagttcatctgccaatattttgctccccgtgttgctctaatctcaatttctatcttaaaaaaatacaatggtaagggggtactttgcaagttaggcctaagaaggagactgatttcccaaggatgttcacgttgatttattgccttttaaaatactagttgcacaatgaaatgacaaattctgccaatttacatactattcctagtgtcattctttcaatttttcaaccagaattcatatacacagaaaacatgcttttcttgtttcctgagttccttcaagcaaaacataattctataatgagcaattatagcctaacacctgctgctatgaagaggaccttgtcaacatctatctaaattgaagaacaacagcattccttgattttgggaaaatgagcaataaacgaagtccatttcttagcagaaaaactcataggcaatgtattccaaggtagctcacagaataatcaggatttaatagaattagattttttaccatcatttgagagaaagttttgctctgggctaagtattatggttaaggaatccaagaaaaacactaaaattcctggatcccttacaggcaatatttacttaaaataaaaccatccataaaagtccttctctactatagtatctcttcctgtttttcttatgaaacaagaactctgctcaagctgaaaggtaaacaaatcggatagaagcatcatttgagctcaagccatatcaacaatcttgtggatttacattgccaggaaatcttttttcaaaattatgccgggataattacatcaacaaaaatggaggcagaaatcttggtataatatcaaaaagatgggggaagaataggttgctggaaaaagcctgctagcagattgcctagaaagaaaaatgaagccattctaatatgttaaaatctcatctaaacattgaaataaatgattattcacttacagagtaaacagatatgtttaagtgtatttttttacgtagtcacatgtatatatgatgtttctgtgtgcctatgtacacgcacacatacatacacacacttgaacgtcaacttgtacgtattaatagtgcaataaaaaatgttgtcagggatgacttcccctctggcattcccagcactatgactgacagctcttactgcatcaatagaagaattgtatttaaacaaaagttatggtacaattcctaggttgatgcttaatagacagtaaatactacaggaactaccaataagcttccttattaaataaatgtatttattcatttgatcttatgtaaagaacacaaaaggtaaaagaaaaaaattaaaaaagagtattttatttttgtataattaaaaaatctagttccttcttcctggatttgaggtatctatatctgtatctatccatctctctctctctctctctctctctctctctctctatatatatatatatatatatatatatatatatatatgttcatatctatatcaatattgataatgtttctttacttcttaaataaagaattacctaagcatcttttttcaagcgggagaatgaaaacacaattattctaagatggcgaatattgacaagggaatgaaatggtgaaagcaaatctatctagaaaaaagggcccccttagcctgaatgaatagaccagtgaatgaggaaacaaaatgattaaatcaagtcttttgaaagcacagcattattgtgagacatattgtaaagatctgtgcagctattctgcccttcctacatactcattgctctctattatacaaagaaggaacacagagaaaagaacattatacttgaagttagaatacctgggtttgagtgtgactttatcacttactaattatgtgatcttgaacaagttactcaacctctttgtgctcagtttccttttctaaaaaatggacatacaggccggacttggtggctcacacctgtaatcccagcactttgggaggccgaggtggcagatgacttgaggccaggagttcaaaacaagcctggccaacatggtgaaaccccgtttccactaaaaatacaaaaattagccaagtgtggtggcacatgcctgtagtcccagctatctgggaggcagtggttgcagtgagctgagatcacgccacttcactccagcctgggcaacagagtgagactctgtcctgattaaaaaaaaaaaaaaaaaaaaggatatacaaatatccagggctaattggagattcagatttgataatgcataggaaagatcctagtacactataagacaccttacatttataaagtagtataattgtcatccacataccattattattacatcatagtgaaaaaatacaacttacaagagttcagctgagcttaaagaatatattcatttgaagcccaatcattgttgtgtgagcttcttcatattatcttatttcaattattatgcttttatcttagactctaattatatatccagttttacttacgccattaaatgaattttaaaaggagtcacattaaataaaggccctttaaattttttatgagataaagagttgccatagacacactcttttgcatcttacccggtacagtcaaactcaattaactattcagactggcaaagcatcttttacatttttcgtaaagattctaagtgaaaagattgtactatttttcaattaagttatatatctttcaaaaatagctggtagattaaagcaaaggcactgtcacaatcacagattctatttagtgccatttagaggacaaaaatgaagccagctagacttgaaaatgtgttcatagtgatttttcaatgtatcaaaatctactaaatggaacattgaatggcaagtccaaaggcatgtgatggttaagaaatctggtcacaggcccagcgcggtggctcacgcctgtaatcccagcactttgggaggccaaggcaggcggatcacctgaggtcaggagtttaagactagcctggtcagcatagtgaaaccccttctctactaaaaatacaaaaattagccaggtgtggtcgcaggcacctgtaatcctagctactcgggaggctgaggtaggagaatcatttgaacctgggagatggaggttgcagtgagccacgatcgcaccactgcactccagcctgggcgataagagtgaaactctgtttcaaaaaccaaaaacaaacaacgacaaaaaaatctgggcacagataattacacaaggatttcacataacctctctgttattcatttagagatgtctaaaagtaattcctgagaaatttggaatttttattgaacatgtcagaatcttctctaaataacttctgaatcacctgtaaatgcaccattgatttggataatggtggaatctagctgtggaataagttaaaaggtcataaggcctccaagggtgaaatttcagtgaggtaaccagccaggctacggagcagctcggtgagcatttcatcagtttggagtagaatatggggagatgataccttttctcaactcaggtaaaaagaatttgaccaagttctcataccagcttttatgttacacagctgtttattaccatcaatgtttttgaaaactgggcagcataatttccatcatgctatgtccctggttctacttattatttggacctcctgatttactgactaaaactactatttaattatctgtatacaaattcaccggccattttcctttgaggtatccctatttggccagaaaatttagagcaaaagatgttcaattcagaaatttctttttaatgttatttatcagttttaactgatatacataatctttcactttactgtcagagatttataacaaaattatccagtgatatctactgaataaaaaagtaatgtttatcctcagtataccaattgttcagttttggtgcaaggtggtttaatatgtcacagctctaggtaagaatatagtaagaaaccctgagagggacatgtttaattgtaaaactgtgaagcacataaatacatacttactattatcaataataatagttaccatttaaatattgcctgctatatatcacaaagcactaagaggcttaaaatacatttttctctgtcctgtacaattctatttaaaaataggcaaaatttctccactttgtatgtaaggagaatgagtcacaaaaatgttaagcaacttgatcaggcccaactgccaataagtttgaagacaggattcaaacctcagtttgcctctccaaatctcaggaactataccaagccatgagttacatattaaacagctaaggcaggtgggcgtggtggctcatgcctgtaatcccagcactttgggaggctgaggtgggtgggtcacctgaggtcaggagttcgagaccagcctggccaatgtggtgaaaccccgtctctactaaaaacacaaaaaattagccgggcttggtggcgggtgcccgtaatcctagctactcgagaggctgaggcaggagaatcacttgaacctggcaggcggaggttgcagtgagccgagatcgcatcaccgcactccatcctggacaacgagagcaaaactctgtctcaaataaataaataaataaataaataaataaataaataaataaacagctaaggctaacagtcaatattaaaaattataaacactaaagtgtttctctaacttattattttgcatttaacaaaataccattttcccataaagtctattgttaaagcaaactaaatacggcctgagaaggactccgtacttctatatttgagtccctgtggatgaactacaacctatctcaataggtagacaagattgaaaaactaacttaggagtatgggcctgtgacaatcactcagtcttggccaatcccagccgccattcttcagccagttatacactgctgattgttcaaactgtgttcaaataaggcaaacagcgagctgtaaccaatccagctgtttctgcatctcacttccgatttctacatgtcactttacttttttttgtctataaatttattctgaccacaaggcacccctggagtctctctgaatctgctgtaattctgagggctgcctgattcgcaaatcgttcattgctcaattaaactcctttaactttaatttggctcaagtttttcttttaacactatattttttttttttgtcttttagcatcatttttaaaaatagcatttaactcctttgattcagtggttgctatggtttcactatttatcccctccaaaatttaacccccagtgtggcagtattgagaggggaggcctttaagaggcacttggatcatgaaagttctgccctaatggattaatgagttaatggattaatgcattatcatgggaatggcactggtggcttgataagaagagagacctgagctagcaagttagcatacacagccctcctgccatgtgatgccccaggccattgggaccctgtagagagttcccaccagcaagaaggccctcaccagatgtgtccttttgacctgggacttcttgaaatggtctttgcaaaaattataacggtgagaaaatgatggaagtgaaagggatctaatctagccaactcctctcttgcctttagccttcaagctgctcttaattattcctgggcttatgccaagctaactttgggagacatttatagtttaaatgacaatagcccttccccaaaactcaaccgcgtttgtagagctaatgagagaccaccaggctaggaggataggggaaactaaattctgctgcggtgtagacatacaggattgccagccattattccagaggtcacaagacacgcgacttccccaactactcttgcagacaacatcactattgtagaacttaagattggccttttgagatatctgttcagatatatttcatgtctgatgactgatggctccacctgcacctgccaactgctcctgtggccccgcccagaagagactcagtgcacaggaggacccttgcccacagtcctatgattgcaatccctaccagtcagcagcaagcacctattgcgtagctttccacatgcctttccccaaaccgatcttgaaaaccctagcctcagacttcttgaggagactgatttgagtaatagtaaaactctgatcttctgcttagctggtggctgtacatgtataaaactctccattgcaattcccttgtcttgataaatcagctctacctgggcagcaggaaagaagaacctattgtgcagatacattctgagcctccataactgtaagaaataagttcctttttgaaataagtaacctagtttcaggtattctgttttatagcaacagcaaatgaattaataccgagcaaatgaattaataccgtattgggatatcttagatgttttggcattgaagctttgtcttacgaaaatgcattcaggtattgaaaccaccattgcaaaattataactgaaatagtgaaagagatctgatgtaaccaactccctcttgcatctaagccccaggctgtccttgctcattcctgggggtaagctgaaataactttgggaggaacttagtttatagcttatggtttaaaacaaaggcaatgacaacccttccccaaaaccaacctccttcttgcctggggactagactgcctttgtaggactaacaaaatagccaaaagattagaaattacggtttagtagtcatgcagctagagactacaagatactgcttctccccaaattgctcctgggcataaagtcaccattgtaaagcctaagatcagtgcttgagacgttttgcagaccctgcactcgatggatcaactggtaccacacagatcaataaactggctcatctcatcctatgaccccccactcaggaactgactcagggcaagacagctttgactccctatgatttcatctctgatccaaccaatcattacttctgaccactggctgctccccacccaccaaattgtccttaaaaaccctggtccccaaatgctcagggagactgatttgagtaataataaaactccagtctcccatacagcctgctctgcatgaattactctttctctattgcaatttccctgtcttgataaatcaactctgtctagagagtgggcaaggtgaacctgatggcaattgcagtatgtatgtatacccaacatcttgtatgtaattttaagggatgcaaggatcccaaaataaactagaactttagggtgatcgagtgtctggtgtgcctgggggctaagcaggtttgtgggatatgggactttaaattttaaaactgagaaattcctgaaaaacaaaaacaaacaaaaataaaacaagaaaagttggttaccctaaaatgtaacgtttatatagcactttaataaatactatttactagaagctaaggcttttggttatgtatattataaattaggccatagggcaaagcaagaaaatgaaagctttactaggtcaaaactgtgaccgcccaagaggttcaactcgcctgctgcctggacagagccgattcatcaagacaggggaattgcaatagagaaagagtaactccctcagagccagctgtgcgggagaccgaagttttattattactcaaatcagtctccccaagcattcggggagcagagtttttaaggataacttggtgggtggggggaagccagtgagccaggagtgctgactggtcagagatgaaatcacagggagtcggagctgtcttcttgcgctgagtcagttcctgggtggaggccacaagatcagatgagccagtttattgatctgggtggtgccagctgatccatcaagtgcagggtctgcaaaatatctcaagcactgatcttaggagcagtttggtgggggtcagaatcttgttgcctccagctgcatgactcctaaaccataatttctaacactgtggctgatgttagtcctacaaacgcaagtcccaggcaagaaggaattttgctctgggaaagggctgttaccatctttaaactgtaaactaagtttctcccaaagttagttcagcctatgcccaggaatgaacgaagacagcttggaggttagaagcaagatggagtcagttaagttagattgttttcactgtctcagacctaattttgcaaaggtggtttcaatcccttcctttgggttttctaacactttaaccctaaggtataggctataaagatgggaaaaggccgtcgatcgctctggcttcttcctgctgatgggggaagtagcgggaatgggaacgaactccaaggtgagaagagtggaactgctttgcaactgtttgagtggattcatgcaggcctaattgggcttccaaggcttgcgtggcagaaacattattactctcatctatagttttactacagtgtttatgtgaatagcctactataaggtataatgagtcctaggatgagaagtacaattcccaattttaaaagcaaacatttgaaatcattagtttgggaacttctaacccacaaacaatttagaatttagtctaaactgaagaattaacctcaagaatagctaatagtttactatagattttcttttgaagcataatatttctctgttcagtccccatttttattaaaaacaaatcatgatagaaatgatttgcttataaaatgcattttagtcttactgtacttggcctgattatttgcatgaagtgcagcaagaataattatttttcacttaggctttttaaattggctttgatggaactctgttccatgaagaatctcagataagactttttgaaagccgagcccagccatgggtttgtaccctcaaatacctatgagttgaccaaagtcctctcctcttgaggtcccaagataacttggggttcctgggcctgttagaaagtgacattctttacttaccacaggtcaggaaccttgtacagggactctgtgtggacaaggtatgaggccagattccccaacgggctttaaatggctctataagtcaactttgattctttaaaggaagcatgccattccagtcaaagccttggtaaaatgaccaatttctccaatggtgtcctgttacaaaagaaaacagattcttattgcacgtatgcaattaactatactgtcataaattgagaatactcacaaatggtttccaaattctagagaaatcaggtagagagaaacaaatttgctccaaaatttgtcactgagtgtattttactcactcggtaaaagtggcaaatagctctaaagaaataagttatgttgactctgaaaacaaaaggattagcaatgtttaacacatcagtttgccacatttagatgttttttccctctattccaagagcataatttttaaagttatctaagacctgcactcagagtattatatccgattataaactgccttttgaaaaggaccaaagcaagataaaatgtctgtggatgacaaaagtctacagccattattaaagctacaattgactaggaattttggttacttccgtggcacacaacaattttacataacaattataattattaatagtgaaatcatatcagaattatagaagtttcccataatttttggaacacacactaataacatatttatacaaatacagtccaaagaaaaccaaacaccattcactcttctatttgaaagttttccttctattctaacgtcacaatctccagagttattaatcagaaacctgcatttaagaccacctgttacattttacagctggtattaaaaccatttttttttgagacagagtttctctcttgttgcccaggctggagtgcaatggcatgatcttggctcaccgcaacctccgcctcctaggttcaagcgattctcctgcctcggtctcccgagtagctgggattacaggaatgattttgtatttttagtagagatggggtttctccatgttggtcaggctggtcttgaactcccgacctcaggtgatctgcccacctcggcctcctaacgtgctgggattacaggcatgagccaccatgcccggcctataaaaccatcttttaagaggacaaaaatgagacaacaattgcctgtggacgacacaaacattgtagagtagccagagttaaagacacaatcgacaaggaaatttgttacctctgtggcacatagccatttaacataattacaattattactgataacatatactaagtcatattagaattataggagttttacataatctcagaacatatgtcaatcatatatttacacaaatatagcccccaaaaagccaaacaccatttcatatttgacaatgtttcctgtatgatttttatgcaaaatacgccaaatgtcatttttggactttagaggacctaatatctaaaagattaggccagaaagagacataatttataatttgattttggaaagtttgccaaatatcaaaggtttaaaacactggatatcacaaaatagaatcccaggtcaccataagtcattcatttgaccaaaacgataactccaaaatcttaaaagaaaaacctttattctgacagaggagacttagctttccaaacaagacccaataaagacagcatgaggataactgaatttgtctcttctctctccccttttcccctgccatttacccaaaggagaaagccaaaccctttcattatcttttaacgttacaaaaaaatcgtcttcaaaagagaaaaccaaatttcatgttcgcattagtgcatctttaatgctaaagctagtttttaaataaaattttatgtatctatccagttttaattagtttgaccacaaggtgacattctcataaactttttagaacgctttataattttccattaaacagcagatcaattttctaagaagaccctgttatttggacacatgggcccagattctggccccacagtatgactttaatattttaacctatagaaaaagctaaataacctttttcaaatcttagccaacttgtttatacccacagaattttttttttcaggatcaaccctgtataaacccttttcactttgcttaaaccctcagtttcgttccgttactcttttagtttaagacagtctttaaaacctctgaactagacaaaattacattctcttcaacaaaagccatattcctatgccttattatctttcaccaaaaacacattccctacacaccttgtatgtaaaactgtttctccagtaacctcgatttcatgttacaatgttaactcttagcaactttgatttttagtgaaaaacctgataaaaaagctattttaattatatgctagggatggagcctaggacatcagacagaagtgaagataaggtctgactcttttcagcatagctaggggcatagctctccacgtgtccccaggcctcatctataatataatgctccaaagtaaataaattgaacaattttccaaagtcaaggaaacagtttgaccttaaagaatttagcaaatctgatagctgaccttaatttagaccaaatgtctacattttcaagatattttactttaacaataatctttaaaattgtctttattgccaaaagattactaaagtcatgtgaacaaaaagtcatcaaagtttctatttttctgacaaaatatttttttatttaagcacttattttccaagccaattaatcagagctcttttataaacatcacacacacacacacacacacacacacacacacaaaaacacatgtaaatacagacagaagatttggcactgataagactttttatttgccagtttcttaatcagattactggcttcagggtggagcctttggaggaacagggccaggaaagtatgcatttctaaggcttaatcacagctgaaggcaaagacagaactcccaaattaagggcaccattttatactgcaacccaaaaggagagaaatactacgggagaagacagtacagtgcttctaccctacatttcttttcttatttttgtttctttctttctttttaagacggagtctcgctctgtcacccaggctggagtgcagtggtgctatctcagctcactgcaacctccgcctcctgggttcaagggattctcctgccttagcctctcaagtagctgggattacaggcatgtgccaccacgcctggctaatttttgtatttttcttagagacggggtttcaccatgttggccaggctggtctcaaactgctgacctcaagtgatccgccctcctcggcctcccaaagtgcagcctcccaaagtgcttggattacaagcacgagccacggcacccggccataccctgcatttcattgcaaggcaacccaaagtcaatcagcccattttgtaatcagcccgtccttcatgggagtctgatctcccagtggagggtgaggaatgtttccttatcttccgggtgaccaaaagcatgcttctctggatccaagtgtgcaaagagtcaagtatccctgtataactaccattagccatcccttaaagtatatttcctatctagttattacacactaaagctccctcataatgtgaagtaatttctgatatccccaaaactcaaaaccatcagataacacaatgaaaaacagagcagagtctttgattttgagagggatccatctgtttttaattcctggggtttcatgtggaaaacagttttttttttttttccctaaaacgggttctgtggtgcctcctctgtttttcccaatgagtcccaggctaccagaagttatcttagggactcacgtgtgcgttaagagtggcaagacaaaaaaattaaaaaagagaaaaaaatggagaaaaataattcagtcggctgagaagaaaaaactttttccaaaaaaacaagttccaagaagagaaaaacataaaggccttttaaatatatctatagcttgtttatccactcttaattaagctgacttttaaccatagtgctctttaaaaaagaaattcttttagatctcttattacctaattttagccatgccaagtggacaatatttttagcttctgaactttaccaaaggaaacctcctaggtgctgcaaagacatagtaagaagtttctttttacaagatttagaatctccacaaggtagtccagagaaaggaaaattcaagagaggaaatcagaaaagaaacttaataaatggcaaagctacacaaataacaaatcagaaaggaatcattccagaagccaacaattgaacccaggccaccactgtcaaaagacaaagccttagctactgagctatatacagcgttgagaaatttctactgcttttcccagaaggagcctagagaagccagtttcaggcttgcaaggcttttaactgctcaagaaaaatcttaggagtaactatgacatgaaccccaaaattcctgtcctctggatggtagaaaccaaaagaaagtatccccacatggtcacaaggttaagctcttaaggacacaaaacaagacagagaaatttcatagagtattggtttcagggacctgtagcaaagtttgtagctgaccagcctcccaagctgacttgaaaagcagacttatgggtgtcctaacccacgttctatcacgtgatatccctctctccattacataacacagaaagacaaattcttagcacaaactacatcagatgtgctaagattagtctcacaaatccttctttctattaaccaaacccttgcagaggagacaaatagtttactatttaacaatgcagagaaagagagagagagagagagagaccagaaacttgactgataagaatttcttacccttattgctgggatgccaggtttctgggttccctttctctgcagcttccagaagaacggagtggcgtcttacgaccctgcttgcttgtgctatagctgtggggtttaagccactttacaagataaaatcaccctttaccattttatggaaccataaacaagattcttaatttgcaagattctgcccaacgggctgcatggggaactgaattaacattttccaacccagcaaaatacacataacaaaacagacattagtcacctctttccgcacccaatatcagcctggcaaagctcaaaatttttcatcttggtccctgttgtctttgatccacaccaggtggggacggatgacctctgaacggtaattcacaatgaggtctctgggcaagggaaagagcagatagtcaccctgagagacaggactgttgagccttctttagagctcactgaatgtgaccagacaaataaggagggttctctgagttaggcatgctggacttctatcagcaaccccttctgagatccctttcacatatttaaacacatgcaaagacaagagggacagaaggccttccaaatcagatccctaaccaagaagtccaagagtatcccttccaaactatcctcctattttctgtatgagaaacctcctcaaaatcttcctgattgaagagaagtctcccaaaccagtagtcttcctactagttagaaagagcgaactgagacctcccaggagctgaacagacaccccacaatggagtaacagacagagacaccccatgctggatctacagacaccccacaatggggctacagacaccccaccatagggctacagaaccagtcaggagaatgaagcaggcattggcagcacctaggatactcaccaatccagacaccccaaaacggagctacagatagacaccccaccatgaggctacagataccctgtaatagggctacagttaagggacatctccccatgactatttttccattgcaattaagtccacgcacattgggttggaataccccaccagtagacagagtaacagagtcagcccccagtccaagagaattaggcagccacttgggctgccttctggatccatcactgaaagggggccaccaaacaacaggcaggtagccacaggggcaatcctgggtgagcccccaaatttgtaaccacccaaggggttcaccttgcccactgcctagacagagctgactcagcaagacaggggaattgcaatgaagaaagagtaattcatgcagagctggctgtgtgggacactggagttttgttattactcaaatcagcaaatcggtctccccaggcattcggggaacagagtttttaaggataacttggtgggtcgggggaagccagtgagccaggagtgctgactggtcagagatgaaatcacagggagttggagctgtcttcttgcgctgagtcagttcctgggtggaggccacaagatcagatgagccagtttattgatatgggtagtgccagctgatccatcaagtgcagggtctgcaaattatctcaagcactgatcttaggagcagtttggtgggggtcagaatcttgttgcctccagctgcatgactcctaaaccataatttctaatactgtggctgatgttagtcctacagaggcaatctagtccccaggcaagaaggtctgctttgggaaagggctgttatgatgtttgtttaaacgataaactataaattagtggaggttagaagcaagatggagtcagttaagttagatctctttcactgtctcagtcctaattttgcagtggtggtttcaaaacccttatactttattttaccataaacaaatgagcttttagtaatgaattctaatgactgcaatggggtgggggtggtgagttaattgttatcagttgtacaaggttgttttattgtagctcaaatgttggaggaaagggaagctttatggtattatgtttcattaaactaagataggctttcagaattgtacaaaacatttttaaacctatatgtattactgatgatttaagtgagtgtatcagggaaataacttgtttggtgaaaaatggaatatggcctgaaaacataacaacaacttcgtaagttgtccattttctcataaaaataatattgacttacttatatattaaattagtgattcaatttctaaaggccttacaaagatataattcagtattttatggtaattattttctaattagaaatttacttttactatagcactaagtgccaccagtattaattattgttatttccttacaccatacttgttcctagtaaaacaagcttcagccactgttctctataaaatatggtgtcttctagatgggaacaagaatattttacaacacataacctcccatttctagggttgtgacaaaatgcattttatttcaaatggcacgcaatattaaaacaactcagtttatgtttcattaatcaagaattcaaaacaacctcattttgtaaatccataatatgcaaacttggctacagactgtccaatcagattttattctcctttcaagtcagattttccttatcctctttacttacactatcttaccaataggctgtcagatgctagtatgttctgagacattcagtatctcttatcactcaccactcatatactctcagggataaaattctgtagaggcactcaattcgcatagaaacaaccataaaacccagttttgcaaatattaagttagaaaacaattggcatagcattacactatggtaatacttactatgcactcctaaaatttagtgttgatcttatgccatgatgtaaaaacaaaaaaagaaaaaaagttattagtacaaagagaaaaatgtcagatgtgtataatataacctctgatttgactaaaatatgtgataacattcacaagccagaattgagtagagctggcagttcacagaaggcctgaagcctagatgtaatcaatgacatagctgaacttgataaatcaacacatttacataaggaaaatatccctgattatcataggattgaaccttctaaattatctgttgacagtcaatattctgatcattttcttcactgtgaattcagacagactatcattcaaaggtttgctatacagaaagagaaaaataccaaaatgctaaggcacaaatatcaaatctctttcccatgaaaatcagataatttagaattttttaaagttaaccttgaaatgtgactatgtaattaaaaaaaataaaatacttttttgtgataagtcaaaaactaattataaggtagaacatttgctaatatagatttcaaagcaacacctgttaataacatatgttcccattttaaaagtaggtaacagaaattaataactcatagttatataatggggttccaagattttatagtatgaaatgtggtaaaaggtttggtatttattataggatgtgaaaggccccctaaagcacttttaattactcattcatgaattgctaattaatacttccaaactaaaatattaaacactttagaaagactgacccaatattaaaatccaagctgttagattttaaagtgtatgttaaaaaatatttaaactataatatctcttagtgtatatatacacacaaatatctgttttcatatatatgtttatatatattttatatatgtatataatatatatacatagagagcgatagagggagataaaggaagggggttttgtttgtccaatatattttagctgaccacatcattttatgtatttttttatttaaagggccaaggaataaaataagaatgcgaaggtagaatgcagcactttatcctcaattagaaaaatgcagaggaatttaaataattagacttttccacaaatgttatgtttgttgccaggaaacacaggtgcttctaaactcactgctttaggccatgcaaaatttaggagacaggccaattcccctcctctagggaggaaacttgtcagtcaggaaagctcaagagattagcatccaaagccagtttacttctggggctggttaaaagctttcagaggattcctgtgtaattgctaaatattgtaggctaaattaaagttgttatttaaaatgtaaacatcaatagcaactaacatttgattcttgctcttggtataaaaaagcaataaaattattaacaccttggaaagatttgaaaattcattggtagcattaagcaagtaaatatctagcatttagttcatatggcgagaccaattgtgagaacttaaaatacatatttgtgttgatgattctggctactgtttgagaggttatattgccctcttccccaaggatttctcaagaaatgtttatttgatttgtatgatacatttccagctttgttctcagaaatgtcttttctactcacattcattcattctgttcagtacaatactgtgttcattatgctgaggctttaaaattagaaactgtgggggtttgaatcttgtttttgccatgtgatagctgtgtgaccttaggcatatttcacagcctcccagtaaaataaagataaaacagatctttcttcatagaaattatttcaagcattcaatgaggatattaaaatacagaacttagcacatggtgacaaaggaagtactcaataaagttggctcttataattatgatgtagctaccctcaccttcttgattatttctgagttctttttggatctttatgacttctttatattcactagtccctctgcttacgatgaattttttctatgtctattgaaattctagatgtcttcaagatgtcacctcctttacgaaactaatcttagctcccccaaactgaatgcatcattctctgctttgcggcccatagcttcccaaagttacccctatttcagtattcaactcaatatattttattttatttttattgctttttgagatggagtctctgtcactcaggctggagtgcagtggtgaaatctcagctcactgcaacctttacctcccggaggattcaagcaattctcctgtctcagcctccagactagttgtgattacaggcatgcagctaatttttctatttttagtagagacaggggtctcaccatgttgatcaagctggtgtcgaactcctgacttcaaatgatccatccgcctccgcctcccaaagttctgggatcacaggtgtgagccactgcatctggctttgactaaatatattttaattgagttaatatgggatctgccttactgtgaattccatgaaggctgtgaagttatttaattcttctgtactttgtccaaagccatggaagcaccttgcaattggtagaattcaacactgggggaggatcttaaagtaacgaataaatatgtcacaatcgtatgtgcattagagagctatggattctttaattaagaagctgctaagagctactcgggaggctgaggcaggagaatggtgtaaacccgggaggcggagcttgcagtgagccgacatcgcgccactgcactccagcctgggcgacagagcgagactccatctcaaaaaaaagaataaatattaattaccagatgacatattaaatatttttataattctgatattaaaacttataataaaataactttaatgagtggcttggaaattaactgtttaattttcaaagaaatattttgcttttttgaaatgaaataaagacatttcttgttcattaatgactggctctggtaaaagtgacacaaaaaggtgagtgtaacagtgttatggaaaaagatgaaacaggatagtaaaataactgagagatgagcaaatagcctggcccatccagcaacgtagacacatatatctaaatgtgaagttggcgggttcaaacgaatattggcgccatgaggaggctcatgatatctattgctactcaattcatttttttttttttttttttgagacagagtcttgctctgtcacccaggctggagtgcagtgtcacgatctcggctcactgcaacctctgcctcccaggtttaagcacttctcctgcctcagcctcccaagtagctgggactacaggcacgcaccaccacacccagctaatttttctatttttagtagagacggggtttcaccatgttggccaggatggtctcgatctcttgacctcatgatccaccagcctcggcctcccaaagtgttaggattacaggcgtgagccaccgtgcggccctgttgcttctccattcttaactgattgctccagctttacaaaatgataaacccaggaattgtgtctcacgcctataatcccagctacctgggggactgaagtgggagaataacttgagcccaggagttccaggccagcctgggcatcatagtgagacaccatctcaaaaaaaaacagcctgataataaacgtcagtataaaggagatacaatgtgactctcggaaaaatttttaaaaaagttatgaattaaaaaactttgaatcagccttgctaaaagtaaaagaacctaaagtacacaggggtatttgatgaggagcccttagaagtaatcttgttgacctaagcatattacaaaaattgaaattaatgagctaattattattcttcacggtaagatacagaagtagagttcagagaatatttacattttgcctctacaaaaggacgtttaaaaaaaaagaagcctctcgggagaaaaatgaagtagagcaaaggacttactcaagtttaaatttgcagtaactctgtctcttgatttcacaaattaaggagaaggagcaagaagttcccagtacatccaatcatacaactatgaagttccctgacatatttaagtatgtatctataaaaacccctaagatactcaatcatgtgagcacaaagttactgtgtaatcttccatagatgtaaactttaaccacgaagtaagtgatagctacaaagcttgtaaaatatgtttattaaaggaaattgattttttttcagtcaatctagaggaaatggcttcggagatacatggaatttgtttgcttcgactggccatctcacaaagctcattggacttataataatttagttaacaccatattcatgtctccataaaaaccctcataagccacgtatatataccaaaattacatacatgtatttacccacagctacaaatatagtctatgtgagtttcatattaaatgatagtatagaatattattctattctatactatattattatagaatattctattctatattataacatatatattatatataactcgatattatatatatacatttctttaggagatactcatggctgctctgtgtccaactacatttgggagtcacctcttactgaatccttttatatactgggtcacttgcaaaggcttaattgagcatttgactatcatatgccacagaatggatcggacactataaataaaacacaaaagagagtttgtcttttctgggcttcatcttcttaaaaaaatcagctattagacaagcatatgtctaattatatatatcaagcatatgtcatattatatatatcaagttatatatgttaaacatcatacatatactgtaggtagctttttgtggtcacaaagctttactattattatttttatgtacttcttgagaaaaggctatctataacaggataattttaagtaaaaaaagcttaaatctttcagtcaatgttcatatattatcctcataagaacaatttgtgttaggtattcttttctattttaaagtagataaaatataggtacaaacatgttaagtaatttgtctgaggtactagaggtatggcgagaagctgatctcaagccaaaatgtaaaggcctatgtttttctgattctcctattattttggttctatgagagaatgttaaagaaaacataactttttcccaactctcagtccaggactgagaaatctcaaacactaagcatatgagtttgtgagcgaaggtttgcacataaatgtatatactcacatttatgggaatatatgatctgtacttaagccataaactaaatttaaaatttatagtttaaacatgatatttcaaaattctagtaaagcagacacacacttctatttacttttctatttatatttatgtatcttctggtccttttactattttatcaagatacttgaaagcagggatacttaaccaaaagctggtttaggaatggattatgaatggcttatgaatggattgcaggagcatttgaactgctggatttttatgtaaaaggttgtatgtaaaggatattcactgtgtatttttctgaggagtcccacagcttttatcagactgacaaaggatgcatgaactaaacaaattaaaaagcaattaaggtctttataacctctatacatagaaagttctatgttttttctactttttatttccagctggacaaataatgtcttgtaaaagtttagttcactgttttctcccttcaagcccccagtgaagtaggagatgatgttatctatttagtacgggctggagataataaattgtgaacaaagtgaagaatagtcatgaaggctgctttacagaattggaggtaatttggtgtcttttatttactgcagctaaaaggttcttcaaaataagcataatctttgcttcagctacatgtgtttcttccagattttctaatgctcttccacatcactgttttcttggttcaccctttacattttagataaatattccacagtgagaccttcctgatcccaaacctgaattaaataaatactcttacgctctctcatgcacttatttttatttagaaaatttatcataattcttgactacttacatatgcttgtctaatagctgatttttttaagaagatgaagcccagaaaagacaaactctcttttgtgttttatttatagtgtccgatccattctgtggcatatgacagtcaaatgctcaattaagcctttgcaagtgacccagtatataaaaggattcagtatgaggtgactcccaaatgtagttggacacagagcagccatgaatatctcctaaagaaatgttccacaggctgaaattaaggcataatctctagaaaaatgttttttaaaagttgtgctttataatatcacatttatcatggaaatatatctgatcattatgtatcaataacagaaatgtgtgctttactattttctttaggttttgctaaaacttactaccaaatatcctgaaattaatttcactttaaagctaaataaattggtctatatacactaaagtcataagtgaacattttcttttagtagacaattatacaaaaaaattcccttttcctgaaggcatttcttgtctctgaaaataagaattttataattggtcttattttccgttttctttggcttctaggggtcccagaataacatacgaatcaattatttatcttcttagccaacacccttaatccaagcaactgacctcttttgctttgattacattactttcaatacattctcataacctcaccaataaagagctatttgacagatgaatgtgatcaagacaccctttgcttacaattcttcaatagcatactactgcttttaagatagatatccgaactcaggagctttcatttcttgaatgaagaggcttctgtgtagttcctcctcgtcttgtagcaccgtaattttcttttttatttatttattttattttatttatttatttttgagatggagtcttgctctgtcgcccaggctggagtgcagtgtcacgatctcagctcactgcaacctccacctcctgggttcaagcgattctccagcctcagcctcccaagtagctaggattataggtgcccgccaccacgtccggctaattttttgtatttaaagcagagatgaagtttcactatgttggataggctggtctcgaactcctgacctcaggtgatccacccgcctcggcctcccaaagtgttgggattacaggcgtgagccactgtgcccagcctgtaattttcttcttagatatagttaccctggcctttctgttccttcccacaataggagctttgcataagctctttactccaacagaataggcttccttgatattctctttctgaatacagataatgtaaatattactttacgttgtaaatattaacatttctctgactgagtgtacgtcttccccattgacagtaagtttcacaaggataggaaacatgttttcagtttttgtcttgttactgttttgttttctcatcatactccagcaactagcaccttttatgtactgtttttaattaaaatttgaatgagtgaactaaaacatcaggccttaaatctgcatacatatttggctctagtcaattatatatatacttctttattttcactaatttggttgcacattttattatgtctccaaatcattgtgaaagacagtaagcaaaaactgacaaattagtacaatcttggaattcatgtattataaaaggctggttcagattgttttactcaattgtaacatgttttgattgaaacggtgtaaaacaggaaaaaattatctagaaccaaacttttattgcatgttggctatggaaaagtacaaataataactaagacgtaatcaactaggccataatcttgatgagttttcagatttgattatattatatatagatataaaataaaggaattaatattttaataaaatcaatgaaacttcaatatattttacaatagattttaaatactatgttgattttttatgaaagttcagaacatcaaaaagactaatgcaacataaatttgccatgagtttatacgcaccttaaaagaaatgttcgcagattctacttgtatcatgatgggttgcttttgtgacataactattgaaaatgtgtgttttttttttctgcagtacaatcttcacattcagatttaattgtaatcttagccaacttttgctcatagaaggattaatcatatgactttttgtttacacacaatcacctgtagaaagcagttatcattctattcatttcttcattcattcaacaacactgacttttatgctactctatgccaggccctgagtgagttctgggagatactaatatacacttaagttctgccatcaatgaacttacagtcttttgagaaagacaaggcaatagtttcagcatgacttgacaaatcttaagaaaaaagagccagagaaacatagaaagagggatctaaattaggctagaagaaatagcaaggagtagatacagggaggaagggtgtcccagacacagaaatatgcatgtgctatataaaattacataatatatttaagaaagagcaagaaggccgggcgcggtggctcacgcctgtaatcccagcactttgggagtccatggcaggtggatcacctgaggtcaggagttcaagaccagcctggccaacatgatgaaaccccatctctcctaaaaatacaaaaaattagctgggcatcgtggcagtcaccagtaatcccagctactcgggaggctgaggagggagaatcgcttgaacctgggaggtggaagttgcagtgagctgagattgtgccattgcactccaggcagggcgacagagcaagactccatctcaaaaaaaaaaaaaaagaaaaaaaagaaagagcaagaaatttcatgtagttgggatcaagggcattttgaggtaagtaagacagattttaggttaaaggggtagccaagatttttaaattctaaacatatttgaaaggaaaaaatcataatctaattttttattactctttattacaaaaacaaatttggttttaaagatcaataaactacatttttaatacaaagtagtatatacaatatgcatgtaattaccttttgctatttcaagctttgctctgtgtgcatacaaatatatcaatacacatatataatttttaaaatacataaaatcttaatgtgtacaacacacatatgacaacgttttgaatatttaaacaaaagcaaatgacttgctaaattgcaaatatgtacatatggaaaatagatatatttgctcatgcaactgctttttaaaattccattacttctgccaaatcaagcaacactcacacgggtggtataagtacacagaaatagcgaacaacataaatgttagcattcatagatcagccttttatgggaatgtaatttttcatgtacaattcactcaacatattaaaacaatctttttatgtcccttgttatggttttatcagacaagcagaacaatttcaagggaacctaagagtagactatcaatattagtcattgctcatgttgtgtttacaggaagttcactaatttacattcgatttatattaataatcaagagtggaactgcaatgaagtgcaaactttctttttaattctcttttctgtagtgtacaaactcatgtatcagtagctttgggggctattagcactacctccagaatataaacctgtcatattttaaatttgcctcatttcagaagttttgtcttcttatattcaaaggagcatgcttggtatgagtcacagtatcaacttctgcattgaatgttttctaagccatctcaaaatgcatacaaattgttagaaatcaatctcaatttatttatctaacatatttacatgatatccaaaaatgaagacaggatagataatagaaatctaatataaacctgtaagctattttaacaacatcaaatgtatggtgtcccttaagagtgctaaatcaaacactacttcttccagaattttttttttttttttttttttttttttgagatggagtctcgctctgtcacccaggctggagtgcagtggtgcgatctcggctcactgcaacctccgcctcttgggctcacgccattctcctgcctcagcctccagagtagctgggtctacaggcgcctgccaccacgcccggctaactttttgtatttttagtagagacggggtttcaccatgttagccaggatggtctcgatctcctgacctcgtgatccacccaccttggcctcccaaagtgctgggattactggcgtgagccaccgcgcccggccttcttccagaatttttgggagatgtaaaataaagagatgatttaaaaagctctttgtgaatgcatattttaatctttactctggctctggagattttatagaggtaggtaaactaaagttgtgtttctaaataatgtttctgtaagatatatttttaaatctataagttaaaatgtttcagagagataatgcgatctgtttgaagccatgctatattttggagacgactttttttttttttatttttttgagacagagttttgctcttgtcacccaggctggagtgcaatggcaccatcttggctcactgcaacctctgcctcccagattcaaagattctcctgcctcagcctcccaagtagctgggattacaagcatgcaccaccacacctggctaatcgtttgtatttttagtagagatggggtttcaccatgtgggccaggctggtctcgaactcctggcctcaagcgatttactcgcctcagcctcccaaagtgctgggattataggcgcgagccaccgcacctggccaaagggacaatatttctttaggtcaaagggaaagtttacaacaaaccacgtaaccacacaaactgcaagaacaaatatttcccttctgagctgccttagcaaagggtatctgggaatatcaaacagaatgattcataagcaaattataatgtccagaatattcaaattttcaatatcaagtttgtgttttaccagcagaatcaaaattataagaaattatcgagtttggtctcagtatagttctatgtgctataaggatcctccagaatgtaaaaaataatacctgttctcaagaatcttatttaacagttgagagaatgagctggatctgaataaaacacataaactatgattcttagacttttatcacctcagagatatgctaggaaaatactgtattttttaagaatccctttaaaaactttccttaaagcaataacacaagcattctagatggttccacatagaagcagaaaaaaaatacaagaaagaaagctctatataaccaatccctgatttaaaattgtgaaacaatctcaaataggtccagtcccatttcattaccaaacatctacaagtttatgctctgggtttaccatcttttgatatctcctccctaataccagtgaaagggatatggaaatttgttgatacagatgttactgtagaattaatactgacagtgatcagtgaaatttacattggggtggtaattagttattaatgatttaaaatttttacagtgtcacctttactgtcttctaacgatgtgtgtccaaaacagtatttatacatgagactcttttttttttttttttttttttgagacagagtctcactcactctgtcgcccagcctggagggcagtggtgtgatctgggctcactgcaacctctgcctcccaggctcaagcaattctcctgcctcagcctcccaagcagctgagattacaggcactggccaccacgcccggctaatttttgtatttttagtagagacggggtttcatcatgctggccaggctggtctcaaactcctgacctcaggtaattcatcccctcagcctcccaaagtgctgggattacaggtgtgagccaccatgcccagccccaccagtaacattttaagggctcaatagtcacatatggctattggctactatattggtcatgatagatacagaacatttctattgcagaaagttctattagcactatctgagcaatataactttttattgtcactaagaggaacttacctagttatttactctggtctgctagtatgattttacctgtaaatataatacagcatatttggactgcaacacataattgaatctttcccagataggacagaatatatgtatttgttctgttcagaaagattcatcccagtttagcggaagagaaaacgaagcctcaacacctataatagctttttaaatatcacaaaactggtgcttatctatcaaagaatactgacaatgccattaaaattgttgttctctgcgctgtatataaatatactgaataatattggttaatatgggtatgcctaggagcaagttgctaactttctttgaattatagtttctcatggtgtaaaccaattctgcttgaatgggtctgctgtcattggatgtggtataaaaattgtgaggagcttagcataaccataacctagggcaaacccaagcccttctcttaagtagcacggcactaaagacttataacttgagtgcttttcaaaggtgtgtggaggctgtatcctctttactgctccttccctgtgttatatgtaaacaatgtttatttagaaacagaatgcttgttccctggtgctgcaaagaaacagcactcgaacataaatttaactctctcagcaaggtcatttttactttttgcagaaagggtacactcgccagcagttttgccacgagagtacaccgaacaaaggagacagggtcatttataacctgacatgtttactctactgctgtgtccggtttccattggctggaacaggaccacacattctgtatttgtcccgattggctagcaacttagaacttttcaaaagagacaaaggcagaggagaacaaaggaaggaggaagtaacttgtttccacaagttacttgctgagaaaggtaaaaacaccttcaaataaggaagaggaacaggctatgacctaatgcgtgcttggaccagtataagcatgccagggcaaatatttaggctaaattgtgggaactaagaacataaagtacattgatttctttattacggctagtagatatttaagaatgttagcacaggtcgtttaataaattttgcttctaggagacgttactatttattcccatttagatgggtaggaaagtttctttggagagaaacctctactttttacacctgcaagagctcaggttgtaagtggctgtatttctttttcaaaggtcacagctcttgttgggcggtctctcctcagctcctccatttccaggatctagtaattgctccctcacattttaccttttttaggcctagtggtgggttatgtctttctattgtccccagagccaggggccacctgcatcacagtattcattagtttcccttaaccctacccacaactttgaatattgtttcttattgcctctcatagtttacccattttagcatgccgtgtgtttgttttcttgctgatctctgatagataagcatccagagatgatgatatgtctgctattaattaaggatttgttcgtcactccatatgagttaataaaagtccaaaatatgacttaaaattaacaaattttgtatgaacttgtggttgttccatatctatctagaaacatatctctagaatagttctcatttcatgtcgagattaagatatttagtatatagtggcattaactcttcatcttgcccattaaaggcaaaacagattgttttttaattatttcttcaaatggaacttcctttcataaagacaacgtgtactgtaagcattctttactgttttttacagccaagaaaaatcgacatagtttacacacctattgatttgtcataagatgtcaactagagaacaaaaaaaacccaaacagattaatggacaagagtgttaattgcaatgatatataaaaaagccaaaattacataatagctctaacgtaatagctctgacacgcaacataagaagataaagaatgaactatctataggtaatatttaaaaatatatgtagaaaccattaaggcattgttgactcaaggacactggaagagatgctggcccaatccaaacagatgctggtttaaaatgactggactattcttacaaggggcacaccaactcagtatcagttctacagcaaaaccatatgacagaatattatggagcaatgtaagtaatgattaagttttacaatgcaaagttagacaccaaaaaatatctaactttattaaggaaaaaataaactgtttagagaaaggatgttttagctgtgggtggctttccctctgttttaaaattatacttttaaaatttctttaaatatcatgtatttctttgttaaagatggaaacgatgaagccgggcacggtggctcacgcttgtaatcccagcactttgggaggcagaggcaggtggatcacctgaggccaggagttcgagaccagcctgaccaaaatggcgaaaccccatctgtactactaatataaaattagtcagggatggtggcgcatgcctgtcatcccagatactcgggaagctgaggcaggagaatcgcttgaacccaggaggcggagattgcagtgagccaagattgcacagttgccctctagcctgggtgacaagagcaaaactccgtctcaaaaaacaaaaaacaaaaaatgaaaaccatgagtaataaatgaaaatcaattaactcagagtgtattaatggaattatatgtgtatcaagtacaatatttaactaaattataattgtaaaactcctgaatttggatagaatatctcagaaatctacccctaccaattttttcatgttaatatcacctcttctaaaatctcatcagctcctaggaaatgcctagattttaaaaagcaactataacctatggataggatggtccctgtgtggccactaggaagctgctggaagagaaagagagatatagtatattctgtagccatgtgacaagtgtgggaccagaagagcagttagtgaggataattttgcacagcatttgaaattcttacattaaagatactttgttggcaatcgcagcgtttatttgtttatttggttttacatataaataaaaatgcattcctaagcatattaaagaggcacttgtattgttaatgtcctactaaagctaggaaaatacagtttttggatcagatctaaatttaagtctagattctgccacctaggagctgtaaaatcttgtgtaaattactgaaaaatctctctgaaccctattatctatattgatgaatgggcataagagaaactacttcaggccaggtgcggtggctcacgcccataatctcagcactttgggaggccgaggcacgcggatcacctgaggtcaggagttcgagaccagcctggccaacgtatagtgaaaccccgtctctactaaaaaatacagaaattagctgggcgtggtggcacatgcctgtagtcccagctacttgggaagctaaggcaggagaatcgcttgaaccagggaggcggaggttgcagcgggcagagatcgtgccactgcactccagcctgggcaacagagcaagactccatctctcaaaaaaagaaaagaaaagaagaaaaaaaaagaaagaaaaactacttcaaatggcttttgggaagaactaatgtgatagtgtgtgttgaatgcgtagtgcctgatagtgcataattaataaatgtttattcccttttctaaaatgaggaagtaaataatatggtaaatgacattttttctcttttttaaattatattcacaaggtagacttgtttccctctatatcagtaagcttgtttatttttaaactggctcaaggcaattgaagatatttcagataacagaagttaacctttccatcctcttggtattcaaattctttctcctttgataaaactttcaaagaaggttttcaatgtttattccaaatgatttcaagttgacgttataagttcaaattaaagtttgaattcaaatccaaacttcctaaacttttctaagacagtaaaataaccattgttctttaggctcacggacttcatagactgtcacgttttatttatttcaggtttgttgtttgccacaatagacattcttctctttgaaataaaataatatttcctctatttattccttgagataactctaaaatttattcattaaaagaatcgtcctttaagtataattttggaaaaaaagaaacttccaaagaggagatattaccccagaaggctggttttttttgtttttttttttttttaagtattccactttaaaaactcaggtgttacagttcactgagcataatgtattggatttctgggaattaaaggcaatgttatttgacaaagttctaattaactggttgtacagttaaaatttttttcttcaaattttctcatcagataacctctcaaatattttctcatcaaataacttcttagaaatggaggttttattttaaaaaagacagtgttacatttaatgctaggattgaaatcttcctaaagtgggagaataaataataatgatgtatttctctgaatgctttattgattccactacaatttgtccatgtgttaccatgtgttaccatacttggtatattatttcatatccagagtccattcagtcttataagagcttattaaatacatactaatacatatcaaattataaatgaatcagtgggcattctacattttacatcgtatatatgtacatatatatctacatataaatgctcaagcatttagttgttaagtgaacgcttttcattggcaagaaaaacttacttgatgtttaattggttcaggttgcatctcatgcacatacttaaacccgtaaatggcaagtggtatggaagcatataagcgaattaaagtatgattcattttctgtgacaaggggtagtctcatttctttactgaagactactgtgaaattgtgaggatggagatctgagcaaaatcagagttctattggaatggacacaggaatgagcctatctggtaggtgattaaggtatctgttacaacttgatacacaacaagaaatccagtaatattaattggtaagacattcttctagcatcacgatattaaatacgtccagaattcctataaaatctgtacattaagttaatttctttcaaaaattaacttttggttctagagtactttgatgtgtttccataactgacctgtcaggcctctgagcccaagctaagccatcatatcccctgtgacctgcatgtatacgcccagatggcctgaagtaactgaagaatcacaaaagaagtgaaaatggcctgttcctgccttaactgatgacattccaccacaaaagaagtggaaatggcctgttcctgccttaactgatgacattaccttgtgaaattccttctcctggctcatcctggctcaaaaagctcccccactgagcaccttgtgacccccactcctgcccaccagagaacaacccctctttgtaattttcctttacctaccgaaagcttataaaacggccccacccctatctcccttccctgactctcttttcggactcagcccgcctgcacccaggtgattaaaaagctttattgctcacacaaagcctgtttggtggtctcttcacacggacgcgactgaaatgacccattagaaaagcatacttacttatgtcttgcattttttgagctataatttttaaaaaatgtaaactcagaaatgtatggaatcactaaaaaaattatagaaaatgggatctcacagttatgtctttgtaactcatgcacattaaaagcaatcccaaataaaaataatgataaatctagcataataaatcattatttctttaaatatatttttcctaagaacagaacgataactcaaatttaagtgttccaaactgataagtcctcaggggaacactaaaagtgagagtaatttaaaagtagaatatcagtagattttagcaaaagaaaaattgatagtgctcattaggaatttatataatttattgaatcataattacactattgatttacataacagactcctttcacaggtaaactttctcctagagttttgtcatattttacaaattctaaatgagttagcccacttaaatgtttgtttcttaaaattttctagcacagaaaaatatgttaataacgttttaaaataataatgtagtgtgtttcttttgaataaagagactatcatgtagaaactgtcaggcctctgagcccaagctaagccatcatatcccctgtgatctgcacgtacacatccagattgccggttcctgccttaactgatgacattccaccacaaaagaagtgaaaatggcctgttcctgccttaactgatgacattgtcttgtgaaattccttctcctggctcatcctggctcaaaagctcccccactgagtaccttgtgacccccactcctgcctgccagagaacaacccccctttttcctttatctacccaaatcctataaaacggccccacccctatctcccttcgctgactctcttttcggactcagcccacctgcacccaggtgaaataaacagctttatggctcacacaaagcctgtttggtggtctcttcacacggacgcgtatgaaagaaacatttaaccattcttaattcaaacacagacgcccaagtaagaaaagtgaatttataaaattgggtaaaattcacaagctgaattattagttcacaaactgaaatatcagtaataacctaaaatagtgtttattctcaaagacaatgtgaaaactctcattaggcattagaatctacttttcaaactcaaaagtgaatctccttgtaattatcagagctaaatatatgtaaacaaagtaactgatttagttaaagtgattaaacttttttcccattctcccccagttaaaatgaacagtggctaaaaattattatcttaaaggtttatccatagttccaattgcaacattttaaaacgtctattcctacatagaccattggaatagaatagagaagccagaagtgaagccaaatacttaaaaccaatttaccttcaacaaagcatacaaaaacataaattgggcaaaggacagcctattcaataaatggtgctgggaaaatgggacaaccacatgtggaagaatgaaactggatccctatctcctaccatatacaaaaattagctcaaggaggattaaagacttaagtctaagacctgaaaccataaaactcctcaaagaaaacctaggaaaaactctcctggacattggcctaggtaaagaatttatgaccaagacctcaaaagcaaatgcaacaaaaataaaaataaacaaatgggatctaagtaaactaaaaagcttctgcacagcaaaagaaataaccatcaacgtaaacagaaaaccgacagaatggaaaaaaatatttgcaaactgcatctgacaactgaccaatatctacaacctacaaagaactcaagcaaatcagcaagaagaaaacaatctctttaaaaagcttggaaacgacaagaatatacatttctcaaaagaagatatacaaatgatcaacaaatacatgaaaaaatacttaacatcactaatcatcaggggaatgcaaattaaaaccacaatgagatacttccttatcttagccagaatggccattattaaaaagtcaaaaaacaataaacgttggcatggacaagataaaaagagaacacttatatactgctggtggaagtgtaaattaatacctctctggaaaacagtatggagatttctcaaagaactagaagtaggtataccattcaatccacgaatcctaatactgcatatctaccaaaataaaaataagtcactatatgaaaaaggcacctgcatacatatgtttattgcagcacaattcacaatcgcaaagatatagaatccaccttagagtggataaagaaaatgtgagatacacacaccacacacacacacacacacacacacacaccatagaatactactcagccatataaacaatgaaataacgtcttctgcagcaacttggatggaactggaggttattattctaagtgaagtaactcagaaatggaaaatcaaatactgtgtgttctcacttataatgggaactaacttatgagtatgcaaaggcatacagagtgatataagggacttcagagactcagaagtggagggggtgggaatgagggataaaaaactacatattgggtacaacgtacactactcgggtgacggctcaataaaatcccggacttcaccattatacaattcatacacgtaagcaaaaaccacttgaaaccctaaagctattgaagtacaacaaaataaaaaataaaatgtatattccaataagaggaagtttgtagtcttatattcttattgctcagcaaattgtacattaagggcatattgaatattccataaaatatttttcactaatttaattactagtaatcatgtaaagccaaaacataaacattcacagggcttcctggtgatctatttcctcatattttttcctcctcattatttgcctcataatgttttgaacacatccactgtcttcaataagcttcccttacaacatcaaatgtgatttcacctattttcccctattcacttccaacagagattttagttggttatcagatcctgttgtggctgacaggcattagaaatagaaaattatcaagttacttgaggccatgaaattgagggccaaacacagatttccaaaaagcttgctgttttcgatatggttatgtcttcagcccacatcctgtcatgctagggcagttttccatttacagaagcaagtggctgtaaggttttgtggtagtcaggtagatgtcacagcgcaaacaggaattaactcaatacgtataaaagagaaagctttcgaaaagaagtttaaggccgggtgcagtgactcaacgcctgtaatcccagcactttcggaggcagaggtgggcggatcacctgaggtcaggagttcaagaccagcctggccaacatggtgaaaccccgtctctactaaaaatacaaaaattagctggctgtggtggcggatgcctgtaatcccagctactcgggaggctgaggcagaagaatctctttaactcaggaggcggaggttgcagtgagccgagatggcatcattgcactccagcctcggcaacaagagcgaagctctgtcccccccccccccccaacacacacaaaaaaaacagcaacaacaacaaaaaacaaagtttgtgtataatacatgccaagagggtaggaataaaataccatttgctgtcaagatatatttctaaacaagtttattaggaaggcagtagcagatatgaaaaaaaaataggatagggcactggaaataataaatttaaatcagcatttttttaaatttagaaattcataatctccaaccaacagaactaatacttaagtataatttccatggtaatgattatttaaaaccccatattgactatgaatttatagatggtgattccatatgcaaaaaagcaaacttgcatttataatagaaatgagaacaaagcaacagaatgtgtaatatgttgaaggagtcattaactttagtggaggacagtcaagttcctaaagattcatttatttattcattcattcagcaaaaaaatagaattatttagttcaggttataattccagattctttataaattaataatgactttaaatgcatgtgaatttcatagtactgtatatttttttatctaggaatatttttccttaaatgatactattctccgaatttaataaagtaccatttctactgatagattatgacttttaaaaaattggtttataattaaggaaaatatgaataaaaaggacaagctgattgattcattaagaggcaaaattatgctagatattgtatcaacaatatattgttttactaacaataaaactaatgtttccattaactaaaataaataattagaatgactaccatttttgaaatacgtagaacaaataacaaattttagtgcatttaatccctattttaattttattaggtttttttttcagttctactttacatacaagcaaacatgctgagctaagctaatacaaaataatacattttctgttgctgttgtttgtcttctgttttttgagacgaagtatccctctgtcacctgtcacctaggctgtagtgcagtggcatgatcttggctcactgtaacctctgcctctcggtttcaagggattcttttgcctcagcacccccgagtagctgggattaaaggcatgtgccaccaggccggctaatttttgtatttttagtacagacggggtttcactatgttggccaggctggctcaaactcctgatctcaggtgatcggaccgcctcagcctgccaaagtgctgggattacaggcatgatccaccgtgctgggcccagaataacacatttaagaagtgattttggctggccgcggtggctcacccctgtaatcccagccctttgtgaggcccaggagggcggattacctgaggtcaggagtttgagaccagcctggccaacatggtgaaacctcgtctctactacaaatacaaaaaattatccaggcatggtggagggccaactactcatgaggctgaggcaggagaattgcttgaacctgggaggtggaggttgcagtgagccgagatcgcgccgttgcactccagcctgggcaacaagagtgaaactccgtttcggaaaaaaaaaaaaaaagaagaagagagagaagtgatttaaacctaagtctgttcaattttaaaacttgtaatcttaaataaaaattatatttagaattatagtatcaattttattggccagttaaaattttaataaagtagatatatatgcaatttgtactatcagctatagatggcttgtttgaccacattttaatgtgttacatattttcatttagtatagttcatcctggaatattaagttccctagatcaaccactttttaatatatactcatgctattgttttgaaaattagagataactgtttagctttaacataaggctttagactggttaactagtagtgtccattcaggtccctgctggtttctgtttgaaatcaaggccaataataacggtcttaaagaggattattggaaaagttaagatgtgaaccttcttgctcaacaaagaatgcaagcaaaattgtcttaatctagaacagtttgaaaacactatcttagtctattagtgtattttttcagtccggtttgtttcttctgcttctttaaatcatagttgtttttctggatgaacttcattataatctggaaattcacattgacatttctcccagaaagccaaataaagcacacatttagaaagcctaagtacagcatctaaagcttccttgaccattataactgaataacagccgtgtagtgtagtgctaaaaaaaaaaaattattccagttacatggttcagtctcttgagatttacaggtagccaattatggcccacaggccagacaagtgactgatcgttgtctgaaaacaacgacgaagtggggaggtgaaaaagatttacggttttttttccccttacaggtagatgttgtttgaaataatgagatttaaaacgctaatgcagagctttgatctcttctttgatgtttcttgcctgttgtctatatgaaatatagtcagttaaaataaaaagccagagaatagtttctactcactaatgattaataaaaactgcttggcaaatgcaatcttgcacattgacaaatgaaaacagaataggatgcccaacaatggtttaaaaaaaaaaaaggtttttttgtttgtttctttgtttgtttacattgccacagtacactgctctttgttccctgaccctgcaagctctcaccgggtgacttcgactttgcacctacttttctcttttttagaatgccctctctcacatgttaccactagagaaacaatcacgtgtgcttcaaggccaaatcaaaaatttcctcttcagtcctttggactgagagagttatgcccaatttcacagcatatggtacaagcctctgttatttttctgtaccatggtattatatgtacttgcctgtgtctcttctagatatggggtccttaactatttttgtgctatggatccctttggcatctggtgaagcatatggaacacttcccagactgttttcaaatgtgcaaaatgaaaactaaaagcatataaaaaacaaaggaaattaattatattgcaattgtaaaatactgaatataatactattatatgctattaatacattagttataagcataataattaatacaaattaaaagtagtgattagtatactaaccactggtatatattaacatatgatttttcaagatatccaaaacaactaggatttgatataaaaatattggtaataaattcacagatattgctaataccgttctgtgttgcttatcttcataaagggaaagaaatgcaaattttcagttacaggttagtgaaaataaagatgtaatttttttcctatcatggttcatggaccccagattaaggacactgtattttgactgtatggcttcaagggcagagtttttatttgttcatctttgtgtctttagtacagaacagaaccatgggcacaatccaagcctattgaatggtggccgaattgtgtattgaacgttcaaatgtcagttctatcactgcccttatcacatcacaagagagaaatttgatgttcattaaaattaataattttaaaaaacattttaattaaaatatttattataattaaaatctgataaacttgtcaatgggtatgatacgtggcactgtgtatattcttttgcttatacacagatgcttgaaaattaaaattaaaaagctactgcaactaagcactcagcaattgtcatatttttctccacttttccctaagtcaataggcaaccatgaagttgacaatgttgctgataacattgtcatactcaacatcatttcccacaaagcttaaacctctacagaaactcagcagtccctacaacacatccttgaagaatgagaggggtgtcaataatttcagctgctcaaatggaaggctctgacatcaaggaatattaagtggcacattgaagggaattctactattaagtaatgaaggtgaggaaaacaatttctcaatccacggttatttctttgttatactaagaaccgtgcccaatacttatggaacaaaataagcctatcatttggacgtctcctatcagcctgaagcctgatgtcatataaaccaataatctgtgattgaatttttcagctttcagtgttttatttttagcataatatttggtattgccatacgtgacttattattctgttcaatttaatcaaattagagaataaacaaaacgacaaacataatttctcttaatgtgcgtgtgtgtttttcttttttgagacgaagtttcattcttgttgcccaggctcgattcgagtgcgatggcatagtgttggctcactgcaacctctgcctctggggttcaagggattctcctgactcagcctcccaagtaactgggattacaggtgcctgccaccacgcccggctgattttttttctatttttagtagagaccggggtttcaccatgttggccaggctggtctcaaactcctgacctcaagtgattcacctgcctcggcctcccaaagtgctgggattacaggcgtgagccagcatgcttggcttaatgtgttttaatgacataattccaacaaccatataactatattagtacaaaaagcaactacatgaaataaaaatctcaattgtttgccaaatggatacaaataatatatattacatatattatatataacatgcatataataaaatacacagtagtctgcctcttatccatggttttggttacccatgatcaactgcagtccaaaaatagatgagtacagtacaataagatattttgagagatagagaccacattcacataacttttatcacagtatattgttataattgttctaatattagttattgttgttaatctcttatggttcctaatgtatatattaaactttgttatatgtgtatgtatataagaaacataatatatacataaggtttggtattatccacagtttcaggcatccaccaggggtcttagaacacgtatccctacagataaggggagattaattatttctaccattacagaattaaaatgagtctgtgttaatcttcctattcaaaaattatttctaattcagagaaattcaaagagagtctataacgctatgcggtttattgacattaaagacattaatagttaattgcttgaagaagaaaatagactttttcagtaataataacaaatttgcagcataattggaagtgtaccgtcctatccccctttgaactataaaataatattttggtaaaatatggtgaaggatccttacagtgtatcttgatcatagtcctcctgagttataattatctacattattatactaaaattgtggctcttcctcataagatattaatatattcactatatgaaattaactaattgcatagctccaataaaatattaacttattcaactgttaaagtaagaatatcggccaggcgcggtggctcgtgcctgtaatcccagcactttgggaggctgacacaggagaatcacttgaacctgggaggcagaggttgcagtgagccaagactgcgccattgcactccagtttgggcaacagtgagactccatctcaaaaaaataaataaaataaataaagtaaaaatattaattgcatacaaaaaagaaatatgctggataccgtccattgtattagcaatttcaaggctaaacattacttttttttttttttttgagatggaattttgctcttgtcgcccaggctggagtgcagcggctcaatctcggctcactgcgacctctgcctcccaagttcaagagattctcctgcctcagcctccctagtagctggaataacaggcgcccgccaccatgcctggctaattttctttgtatttttagtagagacggggtttcaccatgttggccaggctggtctcaaactcctgacctcaggtgatccgcacgcctcagccgcccaaagtgctgggattacaggcatgagccaccgtgcccggcctcaacattactttcgatctcaagactggaagtgcagtactcaacaaagtaattggggaaaaaaatagtttttgatgtaaaaattttagagttcttgatctttgaatgaagttggtctcccaataaatttcaaacgaataagaaacattagatttgtttccttctggctctagtatataggaaagacatttgcaaagcaggtattccaaaatatgaggcaaaatcatcattcttgcccccccccccaaaaaaatcttctagcaactgttgtaacacagagccattataatgtaattagacagactaagaaccagatgctaaggaagcaaaatataaaagatgaagcatgatattattttggttaatgaatttaattccaaatgttacaggagtgattcatggactttttttttcccaaaagatcagttgtcacatgtacatattgcattttaacatgatgtttatgtaatctaatgagaaaagtaaattctcatgtaatattagatgtttcgaaatggataaactgcagacacttccacgggtagatgaataattcgtcaatagtgataagttaatctttaaacttacccctcaaaatggttaagagttaggttatactataaatgtaatataattccataaaaataaccaagacaaaaaatactttagaaatattgaaaatataatatttgttttcctctaatatcctcaatctggtattattgtgtaattcgaatatatggcaatattattattatttttttttttttttgagacagaatctcacttttttgcccaggctggagtgcagtggcatgttcttggcttactgcagcctccacctcccgggttcaagcgattctcctgtctcagcctcccgagtagctgagattacagatgcccaccaccacgcctggctaaattttgtatttttagtagagacggggtttcaccatgttggccaggctggtctcgaactcctgacctcaggtgatccgcctgcctcagactcccaaagtgctgatattacaggtgtgagccaccaccgtgcccggccagcaaaataattcttaaaattcaacttaaaaattactccaagaaatgtgtaggtaaaagtcaaaacactttagtaaatccacattttgtatttccatttatagtaacctctagtgctcattattttgaagataaaactttcttatacagtaagctttttaaaatgtgagaccaaatcaaacaacaagagcgtaatgaaaaacgatagaaggaaaacaactaaaataagaacctcctagctcagatttattctaaaaagttgaaaataaatataatgtagaagttattattatgaaaacataaataataatattttttcatagatagtaacactagctttactctgaaagtagaatctgtgcttcattaatagtgcctgtgtttaacactttgataactcaccatacagaagtatagcctcagtgttcccagattcctgttcctagggatgaatgatcacattaggaaggtacattcctgttaatttggctaaatctgccagcccaaatcataaagttctcctaaagatgctctatctcaagagcaaacacttaggaaaattgttaatgtttataacaaggcaatcaacatctcatttaaatattcagaaattgatccttccacttcatactttcagttaggatgagcattgaaaacatgtagtaaagcacaacctcagcattcataatgaatatgataagaacaagccttttctcattcatgtttactaccaaacatctgttgaataaactacttaatccttacaaacataaccagattattttcagcaacaatacaaactctatagtgataacagctggtcctttactttcttcagggatatacactccacatatatttcatttcttctcaagttaagtgacaaaaagctaaaatggattgtgatgcagtcaaagccacgaatgacacagttttctaccatagacaaggggataattttttttttctttcaatgtaagccacaagtgtaatggggggatctcctaaacgaaaggcattatggtagggggaggttccttttcaagaccacgcctaaactactgataaatatgataaatatatggttgtaaaagacaacatttctttttttttttttcgagatggagtctcgctctgtggcccaggctggagctcagtggcgtggtctcggctcactgcaagctccgcctcctgggttcacgccattctcctgcctcagcctcctgagtagctgggactacaggcgcccgcaaccacgcccggctaattttttgtatttttagtagatacggggtttgtatcactgtgttagccaggatggtctcgatctcctgacctcgtgatccgccggcctcccaaagtgctgggattacaggcgtgagccactgcgcccggccaaaagaaaacgtttctatgaacacagtattacttatacaatatttaaaaacatattatttgatgctcaatgttttataaacaatgattcaaaaatgcagagctgggtgagcacggcggctcatgcctgtaatcccagcactttgggaggccgaggacagaggatcacctgaggtcagcagttcgagaccagcctggcccacatggtgaaacccatctctactaaaaatacaaaaattggccaggcatggtggcgtgcaccagtaatccctgctattcgggaggctgaggcagaaaaatcgcttgaacccaggaggcagaggttgcagtgagccgagatggtgccactgcactgcagcctgcgagacagagtgaaacccagtctcaaaaaaaccaaaacaacgacaaaaaaccacagggctggccgggcacagtggctcacacctgtaatcccagcactttgggaagctgaggcaggtgggtcacctgagctcgggagtttgagatcagcctgagtgataaggcaaaaccccatctctacaaaaagtacgaaaattagctgggtgtggtggagcgctggtagtcccagctactcgggaggctgaggtgggaggatcacttgaactcaggaggtcaagggttcagtcagccatgatcgaccactgcactccatcctggatgacagagaaaaaaaatgcagagctactgaggtatttacaaagaaatataaagcacagcacgtgctctcaggaaatctataaaaaagttaaaaagttatggaatcaaagttaatccacaggaaataattagcaagcaattatgtcgataactgggtagaaataactatgtggaacaaaagttcatagaaaaaagaggtgtttcaagccgttagagaaagtgttgtggtaactaggacttgaattgaatttttgaagatgggaatgctttagaaccaaaagtcgatggaggaaaaagattccagaaagggggaatcagactagaaaagcaagaataaatgagctggcctgtataggagagagaatattttatgcagagtatatagataaagtaacacagttcaaacccttaaaagtgtatagccagcatagttttctgccaggattcatactgctctcaaatcagaagatactctactagatttaagaattacatagtcaatcagctgaaagccttggaactttcggctacatagtcattaaaaacactactattatagctcaatttcaccaggccacattatatatatatatattttttaacataatgtacacaatacatatatacaattttgccaattaaacttgtttttcaaaaagtaactcattttatctaaagaagttaagctcatcaaagcaaagtggaacagtggtagccagtaactggggatggaaaaaaatggggaaatgctggtcgaaggatagaaactctcagttataagatgagtaagctctggggatctaatgtacagcatgttgactatagttaatagtactctattgttacttgaaatttgctaagagagatcttaagtgttctcatcataaaaaattataatggcaactatgtgaggtgaaggatatattaattaacttgattgtgataatcatttcagaatgtatatgtatcaaatcatcatattgtacaccttgaatatacccaatcgccatttgtcaattatacctcaataaagctgggggaaaaggtacctcatatttattattacattttattgttataacacatatattttatctcatttgacccttgaagtaactgaacctaaaaagcagtatttttagatatgaaaactgaggcccattgaggattaatgattctcaaagccacagggtaagcagtaaagttacaactcctctcatgtgtcctgattacaaatcattacctaacgtctgtaatttccttgcatcatcgagaacctgaaacttttatcataaaaacatttctaggaaatctggtaccatacgctaatcaactatggaaagaaaatccatttttaaaggagtatctcaacttgttgcaatttgcacataaaaatatcctttgtctcatatactacgggacaaaacagaagcagaaacaatgaaataggttcaccattagagatctgactagtcttgaaatgtagacaattcaggtcattagtcatggagtcctaaggggaaaaagcatgcctgattccacactagtaaagccagaagctatctaatttacatcctatacttggctgaggatatcagatgtgttcaggctgaacaagttcaagactcttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtggagacggggtttcaccgtgttagccaggatggtctcgatctcctgacctcgtgatccgcccgcctcggcctcccaaagtgctgggattacaggcgtgagccaccgcgcccggccaagactcttgcttgagtaatttaaagggatgtgacacagtctgaatagtaattggttatttaataatcctgcctgcagtggcaacataagcttgctttactcttaagcactggataggacaaactgtcttactcagtcctaggaaaagaaacgttcatctgaacaaaagatttaaagtcgacctgatgtgaaatcctgaaatacattttgaaaatgaatggattagcgataaaattaatgagaagactaaagtctctgaaatgaaacatttttggcatgtgataacctgatatgctcccctcaaaagtcccttggaattagcctagctatctcagcatagcttttcttacatcatgggtattacattagccaagccaacttgtctatttgtccttgtctcacatcacttttcaccctcaacttttactccatttatgccaatctccttatccacagcaagatgctactttgactttttggcctttctcagcatgcttcttcaccactgtggaagagcttcccagtacaactactactactgccaaccacaacctccatatctgacactaaatccttgcctactaaactgctcattatctttaaaattggcatcactcacttctacttcacacatccactgttcgatatccagccaagcctggactctgactgatcacttcagtgctacatacaaagacaccttagactttacttccttgaactttattgaacatctttacttccttgaacacattgtatatataatagagaaggaggcatataacatgacatatgtcaaaaatatgtcatatatgtcatatatatgttttatatatatatatacacacacacacatataaaatgagctcaaggaagtaaagaattgtaagtattgtcttctttctccaatacctactcctctttgctaaggcatcagatgatgttgtttgtgactcagtaaatcactattatccaccatcaactgaaccatgctgttactctttcccattagtttattccgcaaatacatattaagctactactgcgtgactgacaatatgcatgttagtgtatattcagtggcgatcaaggcagttagaggatggatgaggagagcattccaggaagaggcaatagcagtacagagactggcatttgagaaatggcagcaggtcagtatggctgaaatgcagcaagactgcagaagaaaaggaagaaaaatgaagtgtggttcttggtaaagatattggacgcatcagagcagtaacgaattttaatcagagattgacacaacctggtttatgtttttaaaagctcaacctttaggccatgtagagtatggagtgagtagaaaaggacaaaagcacaagtggcaaagatgagttgggggattattgtagtatctaagggtaaattagactaggatggaaacaaaatatatggatgatatatgtccattttctctgctgttccatgagccttttcttcacttactgggctatctggtccatctcccataaccagtcttctaacccttcctattgatttgcaggttcactaactgtttcctttcgatccacctcctgttcacttttaggtactaaacagagtgaagtcatcccgtgtgagtttcctcaccctccctccctctaacatcttaagtgcctttgccctgttttgtttaagcatgtgaaacaatttctcgctaaccttctgtgttactttagattctccccagacagacactgaggcaaggatttgaggtgcaggtacacagtttatctggcaattgattacaaaaagtacaagtgagaggaaagagaaagtgagattaggaaaggtaaggaggcaatcaaaggtgtgtcaatgagcacattattctggggctcagtcctgctggtgaatctctgagaagctgtgaggaacatgcctcagaattatgcaccagaagatgagatggctgcgtgcttttttcaagtacttccatcccctcgtagttaaaggtcgcttctggtgacattaacacaacccctcatatttctggcttactcctgtttatagcaaagcaagatactgcatggaactcgggtggggaaagaaatatgcggcagaacatcagcaacaacttttacatcttcttatcccttcaggatcttgtttatttctctcctctattgaaacactttttaggccaggcacagtggctcacgcctgtaatcccagcactttgggaggccgaggcaggcggatcacctgaggtcaggagttcaagaccagcctggccaacgtggcgaaaccccgtctctactaaaaatacaaaaattagccaggtgtggtggcgtgtgcctataatcccagctactcgggaggctgaggcaggagaatcgcttgaaacagggaggcggaggttgcagtgagctgagatcgtgccactgcactccagcctgggtgacagagcatgactctctcaaaaaaaaaaaaaaaaaaaaaaaaaaagactttttaaaggggttattattaggggctatatactggatcttataaatcatctagtccaaccctattatgtgaagattagaaaacaaagcattcacattattctatcgatttttggaatgctatttgcaaacttttttctgggcccacttaaatgtataagttttccatattttatgttggttaataagattaaaaccaattttaatatcttgacaccacattgccatttatcaatatgtactacgttttttactggttcctcaaatctcaaatctgtgccagcgtctgttgaatttttataattttgactcaatttatcattcttttttttttttttattgagacggagtcttcctctgtctctcaggctggagtgcagtggcactatcttggctcaccgaaacctccgcctcccaggttcaagtgattctcctgcctcagcctccctagtagctgggactacaggcgcatgccaccatgtctggttaatttttttgtatttttggtagagacggggtttcaccatgttggccaggcaggtctcgacatcctgacctcaagtaatccgcccaccttggcctctcaaaatgttgggattacaggcgtgagccaccacgcctggcctatcattcttttttaatttgcagacttttaagaacaggctaatttgagacacagaaccacaaaagctacttacgttccaaaatgctctgcagaatctctttttgcatgtgctacgtatggcctttgggagaagtacattttttgtagttgttttgtggttttttgaaatgactagaaatatttttagggccctagaaacctccaaggtaagtgtttagaaattgtgcttctaggaatctgtcagtacttttgtaaacattatctgaagcataagcataaacaaatttgaacagcaggctagctcacacagaaatgattttattcattggaatgttctcacatgtggtatactttatttttagtttggtttcatttatgattaataattatgattccaaaggtgcttaaatcagccggccatggtggttcatgcctgtaatctcaacactttgggaggccgagatgggcagatcacttgaggtcaggagttcgagaccagcctggccaacagggtgaaaccccgtctctcctaaaaatataaaaattagtcaggcacggtggtgcatgcctgtaatcccagttactgaggaggctcaggcaggagaattgcttgagcctggaggtggaggttgcagggagccgagattgcaccagtgagctccagcctgggtgacagagtgagactccgtctcaaaaacaaacaaacaaacaaacaaaaaacaaaaaacaaaaatcaaaggtggtgaaataattttgttgaatatttggcactgtctacattaatgcacacactcaatgtatatattttaacttaatttatacttaaaattgtataaaattattttagtcaaagaacctaatgcagcttagccttgattgataatttcattatctttaattacatggcagaatttctcctcattactctttaaccaaaaggctgtggtagaaatcattgatgctcatttttattggaaagtaatttttctagatttcctgataattgagtgataacttcagcactccttagtcacttttcattatgcagacaaaatctgactcttaactttcaaaaaaatatcttaccataatgtattttcaaataacatgagtttaattaaaaagaactttcccacaggttcatgtttaatcttggtttgagtcttgaatatagagtgaagcgaagtacaactttttctgctttggacaaatttagagctgcttgaagagataaaaacaagcggggacctccctctaaaccttccacttctctttctctccctctctcaactgtgttccgaatgctttctctaaaacacagaggctgagttttgactggctggaaaaacatcagtttatttcatgttcttcctttctccagcttccatttcaattccaagtgtggcccaaaagaaaagataggaactgcataaggatgtttcagtcaatgataaactgcatataccgcagtggtcccatttgattataacacgggatttttactgtaccttctaatggttagatatgttttagacattgaaatatttaccattgtgctacagttgcctacagtattcagtacagtcacatgctgtacaggtttgtagccaaacagaaataggatataccatacaacctaggtctgcactacgctataccacgtaggttagtgtaagtacactctgtgacattcacacaacgatgaaattaccttagtatggattgatcagaatgtatccctggtgttaacacataactgtatatatcctgtgtgtgtttgtgtgtcactgaagagatatgattccttcaccatgaggaatcagaaaactgaaaaggtaaacaaattattgtatcctgaaagtctcaaatgagtttttgttctactttcttttgtttttttttgagacagaatctacctctgtcgcccaggctggagtgcaggggtgcgatctcggttcaatgcaacctccgcctcccgggttcaagcaattctcctgcctcagcctcccgagtagctgggatttcaggaacctgccaccacaacctggctaatttttgtatttttaggagagacagggtttcgccatgttggccaggctggtctcaaactcctgacctcaagtgatctgtacacctcagcctcccaaattgctgggattacaggtatgagccaccacgcccggttcaaatgagtttttttttttttttttcagtccaatattaaaacaaacgaaaaccagaatgccttttgttctcacattcaattcataatctaatagctatcagaataaaatgtcatatttattattcatttggaagaaaacaaacagcagtaaaaattgaaataaaaggctgggcgttgtgagtcactcctataatcccaacactttgggaggccgaggtgggcggatcacttgaggacaggagttagagaccagcttggccaacatggtgaaaccctgtctctaataaaaatacaaaaaaattagctgggcgtagtggcgaatgcttatatcccagttacttgggaggctgaggcagaagaattgcttgaacccaggaggcggaggttgcagtgagcccagatagtgccattgcacttcagcctgggcgacagagggagacgctgtctcaaaaaaataaaataaaaataaaaataccctggccaggcacggtggctcacgcctgtaaccccagcactttgggaggccaaggcatgcgaatcacgaggtcaggagttagaaacaagcctggccaacatggtgaaacctcggctctactaaaaatacaaacattagctgggcgtggtggcaggcgcctgtagtcccagctattcgggaggctgacgcaggagaatcacttgaacctgaagggcggaggttgcagtgagccgagatcgtgccactgcactccagcctgggcgaatagagggagactctgtctgaaaaaaaaaaaaaaaaaaaaaaaaaaaaaaaaaaccgaaagaaataaaaataccctgtctttattttcttccttggcaaaattgtctgtaggattcactcatccatttatttaattaatttattgaattcccattacattccaagcaggtattaactactaaggattcaatgatgaaagacaaggtgtataggagacctagtacgtacagccttagtttcttttctcagatttatgctctaaaattccgttaagaatggatttattggctgggtgcggtggctcacgcctgtaatcccagcactttgggaggcagaggcaggtggctcacctgaggtcaggagttcgagaccagcctgaccaacatggagaaactccgtctctcctaaaaatacaaaattagcttggtgtggtggtgcatgcctgtaatcccagctactcgggaggctgaggcaggagaattgcttgaacccaagaggcggaggttgcggtgagcctaaatctcgccattgcactccagcctgggcaacaagagcgaaagtccatctaaaaaaaaaaaaaaaaaaaaaaaaaaggctttatttttatgaagaaaaccataaattaatgtcataaatcttatctatgttaataattatcagttgctttaatcatgaaaacaaaagggaaaaactggcaagtgagccaggctgaaataattcaatataatatttaaagattagaaatatggtacacttgttttctaaagatcagctccatcttatcaaactggaataacatctgaattaaaataatgtgacattgtcatcaaagctctgattattgctgaagcatgtgataggtaggactggccaaaaattaatacattagaaaagttaaataaaaaataatatatatttccttgatatgtttaatcaaaaacatggagaaaataattgtaataaaaatgtctacatccttaaaggcatgttcacccctaactctcagttacgaacatctagattaaatttcattaaaagtcaattatccatattaaacatttaatctaaacgttgcgccccattagaatacatcaaaagcttacattttactaaaagaaagtgactacaatgaatgaacatataactttatagcaaaggttataatttttgaatgtttgactttagttgttaacatttttaaagacgttctaattttttacgaagcattataattaagcaaaatatccagttttttcatagtttcagttttcaaactgtggctttggtaaggtaagttggaaaacatcttagttttaatggcccaaaaggggagactttgatgtatagtatagattcaagtgcttatctcatggatcatgctttcattttactaaaaatataatagactaaaactttacatagggagaaatcgcagagaataagaatcaaaggagtaattaaaaattgagggttttgggaggctgaggcaggagaatcacttgaacatgggaggtggaggttgcagtgacccgagatcgtgccattgcactctagcctgggtgacagagcgagactccgtctcaagaaaaaaaaaaaaaattgaggttttacgtatttgagacctaatgaccaattgtttacttttgtcaacagtaattttactgctaagtaatttaagtaattttactgccagtttcagcaggaatacaatttcctaacatagatatttaatattttattcaatattttaatatattaatctttagtagaatatatgcttcaattttgtgaggatatgtgtttattttcttgtacagtgtaaactaaacaacgcataaagagaacacaggtaactagattaagaacaattattttctgctctttgtattagaacactcattttctgttcttagtaatctagcagcatcagcatctcctaaaaaatctgttaaaaatgcagaggttggggccccacttcagaaggactgaatcagaaactctgggggtggcatccagcaagctgtggtttaaccagccctccaggtgaatctgatgcccactcaaggaagagtgagaaccactgttctaatctatcgtcttccaagagtgtgtgggaagatcaaagaaaaatcaggtcatggggctttgcggagaacaatcaaacaaatacataaatcaaggactctataagcataatttaataaatagacggatgattgtttttaacttatttttcaatttcctccttagtttgtacatgcatttagagataatctcagcaatgtcagcgagcttggtggcatagttcaagctgtgaaggttcaataaataggtcggtaaacattgcaaatcaacacagcttttgatgaaatgtcaggcaagacagggcttagctatattcggctcagcttgaactcataaaccatcaactggcctctgtacttccaggacaatctgatgaataaaatacagatataaaattaaaaaatatatttataaagagattagtaaaacagcaatctgtaagtgagaaatgacaaccacttagtccagaccaaatgagagagaagacttgcaaaagggtaacttttcttacaaatcaagttatgggaaaatttgagatccaaatagacttttaactttggattgtctttattcccaacacacgtttttaatttaatgcggtgtactttatcctaactcttttagctcacccccctgaaaaaaaaactagctgtcttcctaaagatagagaaaacttgtccaagtcagaaactctttggaattttaataaaagtaacataatttagaaattaatatacttcaaatatactgacagtatatattggcaacagaatatatgctaatttagaattttaggatattctataattaaaaaaaaacctgataaatcactacaccttttcactttatttagaagctaccatttaataataagtgtttaacctctaaaatcattctgagatatttcagataattaggcagcctggaattactgtttacaattgtcccagtttgcttcctaataagttgtgcttgtctaaacatgtctaaattactattcacaaggatccttgttatttccgtcttctttgattaaaaacttcttaaaaatgtgagtgtatatgtgtatgtatatatatacacatacacatattcatatgtacatatatgcataaataagcccatatatatatgtgaaacacaggtttttctattgttaatataaaaatccctcattagttttctaatgagtttatgaatgtagtctacgtccttagaaatttaatttgaggtaaaaatattatcgtttatagattaaggtctggatatttttttcttttcttcatactagaaataattttagatacctgaagacaaagttcattaaagccacaacccaaaaagtagaatatgggttccttcttatttcagtgatttgcattatcctataggttattggtgtcaaacccctttcttcccttcctcacaacaaaagccccaatttaacttttatagaaaggcatatggaacaggagtcatccaaatatatcccaggggttgcaaattgaccaaaagagtcacctttagggaagcctgcttctgaatgcttgtggaatttatcattcttctgaatggctgttgcatttatctgcagcttttactcaccagatgagacctcagacatttcaaattctgcggaggctggctacacaccttcataggaaagctttttgctgatttccctgttggtacttttctcttacacattctatggggtatggtaaacctggaggtagagtcatagccaagcacagataaagcaggcacagaatctctgaccagcctcacaaaagcagacaaacacacaatctttttgcacctgtttcttccactccggttgccgtgaatagtgaggtgttctcacagattcagcttcacagacagcattttgcaaacactcccctctcacagcaatggtttcttccctcaccggctcaatctacctgattacgttcccttctaatcagtaacctcagttcctctagaaataactgtgtcgtctgctttatataggatttatctgagtctgaagcagaaactggaaagtagacttagaggagctgattattatgaagacacctgtatttttgtctggtattcacgtgaactcgacagtgcactcatttatgcaaactggtgttagtgaaaaagaaaaagaagcagagaaggaagcaaaaagaagagactggacctataaagttgcgcacctgtgtgatgctaggagaagaaaataactctaaaaacgtccagtgctgctgaaaacacatttgaacttcctatgaaaaccaacagtgcttgacatacaaatatcttcctccagacacacctttaaaaatacattttaaaatctgaaacaatcttaaactcaatctaaaccacaatgcagaagttaattcttaaggcaaatggagattaagaacgaaacttcatccacataaaccctgtgttttaaaaaaagaattaaaaggaataatccgtataacttactcaaatttgtatttgaagttaaaccttgaatcctgcttcttgaaaaaacagaattgtgtcaggcttctgtaatgactgtttacccagagcataagattgaagtggattttcagattaaaaataaaactcttaagtatgtcaatccccatctgatcaaagcatataaactaaatttttccaaggacttcattaacaatataaccaagtagagctgcagttcttggttttctttagagtaagttgttaaaatgattgaagttcatgtaaaagaaatccagagttacagttaaggtttgctttttttttttttttttttttttttttttttagtagatccagtgcccggcaaacagtatgtgctcaacatatgtttatttaatgcgaccaaaagcatacaatataaagtgtcattatcattgccactgatatttttaaaaagccatgttctatacttatttcatttttacgtaagccacaattttacaaggtttcaaacaaaaaaaaaaacccacaccttgttttctttaatataaaatatttggcaattataagcatggaccgtgctggcagtaagttaaaatgtgactgattttttttttctccgttccctactctcaattttcagatgcggaaatttcatttggagagaacaggaggtgttggtgggaaaaatctcattaatcgtaccgtattcccttgtctacaaagagtactgcatccaaattacagaagaactaaagaaaccttgtagcatgagtataattagcagtgctactaagtgaatggaaatggaggttgcctaacttaattaactgtaatcattactcattgtcgtactgcttagaaagattagttgagggtatttcttctgtggtattactttaggcgtttctccttccctcttaaatgtgaaacaattacactataaagaaagaattagcatgccctttcaatcagatagaagcttttccgaacaagtaagttccatgtcctagctcgagggcggcaaaacaggaatgatgggaaaatatttagttgggccaaagttagagaaattaagaaaaaagtagttaattgcagaagttactgacttgaggaggaaaaaaggaaccctatatatgagtttctgtaaagaaattagctcttggccagggaagaaataaataacaaattaagatctaaagggaaaaattaaggataacacagtacaaatacgcagtactgtctgatgaagttgttcacaattgcacaacagtgcaagattccacaatgcaccttcaaggacactgtagctaaggattgctttctgatcatttatccttttagcggaagacacttggcatctgggaacatttgttcttttgaataaaaatcacctcatacctaaaaggaacctttataaatatcagaaaaacaggaatgtctgtgacgacgatcattggtggggcttggcctcattagctctggggccactagtgtaaaaaaaggttcacagggactctcttctagtagggactatatatatatataaatatatatatatatgacggagttttgctcttgttgcccaggttggagtgcaatggcgtgatctcggctcaccgcaacctctgcctcccgggttcaagcgattctcctgcctcagcctccggagcagctgggactaccatgcgccaccacgcccagctaattttgtatttttagtagagacggggtttctccatgttggtcaggctggtctcggactcccgacctcaggtgatccgcctgcctcggcctcccaaagtgctgggattacaggcgtgagccacagcgcctggccgggacttcatatttaatgaggcttttcactgttctaggaattaaactgagtttcaggtattgcattcaagaatcttctcagcaaacctgcaatattggtaatgttattccttaaactcgttttacaggtgaggagattggagctcagagaggtttttcagtcatccaactaaccggaagtgcttaagaatccagctctacctgactccctaaacaagtgtgtgtcaagagttaatgggcatacaaaccacctgggtatcttggtaaaatacgggttctgattcggtaattttaggtgggacctgagattctgcatttccaataagttccctggggctgctgcggctgctgctgctgctggtggtctttggacaacacatcgggtagcgaggcccctagacccgtggttctccaactttgctgatattagaatcccctgaagaacttctttaagaaaaaaacccagtgcccaaactgcacttcatatcaatgaaatcagagtctctagaaatgagactcaagcaattctaatgaacagccaagtttgagaatctgtacccattgacatgttgttatcaaattaggtgctcatcagaatcaactgacgagctcattataaacccagagacctacattcattaaagcagtgataagacttaggcctttgcacatttaggtagaccccccaggtgattctgttatccaacagtttgagaaccactttctagaccatgctccttcaaatcaatcagaccaagccctgcagacaaacttaccattcaggcaaaaaaagttgtgagtaggagcttgttttcatgcatatcctcagggttcatcggtacgataagatatcctccaagctaaaaattcatggggccctcacaccaccacatccccagttacagacatttttttaaacctcttttgtgagtatcagtgtactcattgtatgcttacactgtgtgtgggtttttatgcctgtggttgcgcattaaatctattactttgtcagtacttcaggggaaagcgtatcaatgttgtaagacatttaatatatgcccagggtagctgtataattaaaaggaattgattttgaaaaagaacctaatggtaacctgaaatgaatagacaaaatgatccctaagctcagtaacaactgcagcacaatgtatcaccttaggttaaaacctagttcataaataatcctcaactcctcttcaagggcttgtgaagatgagggtcattttgagaagtgacacattttggcttcaggggagttttagcataactgctgtcagattatatcttcttaaacattttcgttggcagtgaagggaagatgttagatcatgttagaaatgtaactaatggggtcaaaattttacttccttacagctcttaagagcacatacttataggaaactcttttggatatctcccttaatattatctagaattgtccaactattcctttaaatgagcacaactggggccactccttatggctctgggcattgcaccttgcacaaaggtgcttgagtatcatacccacattccccccagccatccctgtgatcctccaataaagcagagtcatactgaaaaaaaagcgtgctttctttcaaaattggctattctgtggatttgggaagtggggaggatgcctctttgtttaattttcaaagagtaccatataagcgggtagcagtcctgcggacaacaaagtgtaataaaaaatgtttgggatttcagttggaaggcattgggaactaattttatgacctagggcaaggtatttaaacttttagcatcaccaggctttccagctataaaatagcttggcaacatgccatagacaatcaacactcaggctccgaagtcaaagcaatttaactagggcttgaattccagttctcctatgtactagctgcataatcttggcacgttatgttatttatatcacatttcgttgtctgtaaaatggggataatatcaattccagcctcctgaggctattgttagtttccactacaaggtgtttaccacagttccagatacagagttagtgctaaataaatagtagctactatttatcaacaacaataataagatgataatcactcacatttcccaaggctttggaggaaattaaatcaaatgatgcatacaaaataagcctttgaagtgaaaaacaccataatgttgttgaagatgggttttcttccttttagtaatatgtttgccatatctttgattttaaagaaatagtagtggttaaaaaaaaagcaagtagtagggccaccaaagatctggctacaataattgttctgagaggttaggctcctgctgagagttggagctaaacctagcacctatatgtagtagtacaaacctaaatatacagtacatcagggaacaacgtagacttcgaatgtacagatttaaaactagaactgcaataacctggtgacatactgaataaattggaagtaagtccattaaatcttgtctctagagttattattcccaataatcacaattttttaaaatgaccatcttgaaaatcatgtttcctggagtcacctccaaatagcagtaagctacccatctcctattacaaaaagaaaaatgagaccagcttgtaaacacattacccaataaagtaccttacagtgcaagcagggaggcattattgctcaatggaagtcaatttaaaataagaggttaccgagctttctcaataagagtaaaggatcccggccataattgttctgcagtaactttggaaaggtgtacttttattcaaaccgtgctatgattttggcttctctcctagggaggaactttcatttcagtaactaagttcatgaaaagccaaactctttgcagctcttcagctggcagcattttttccagtttctacaatctcatcactgtggtgtgtgtctgtttacttaacgattttaagcacaattcttcatgacccatttatttttggatactgttcttttattttgattgcatatctttcccatagggttacagcaagtttgaaggaaaatcaaacaataaaacactcactcaatatcataggggtatttgctttcaaaagtcaaacagaatgaaaatctatctggttggttattttagatgattagtgttaatttttgcacctgatgaccaaaaatcattttagaatttgatataaggaacttttgcacagacatcttacaacatggaatatctctaagtgttaagttttacataaacatgaacatctggaagaacttgagccaacttgggagctattattttacccagcctccttcatcaaacagagctcagaactcccctccgttagctttaagcttttctcaatgaactgagtaatggaatcttgagggacacctttaaatccagcagtagaagcaaaaaccttccccactgataagcaaaagaatatttctggcaacaaaacccatcaactataggcggtatatatctaactcagtcagccttgagttaaacgtgagtcagtaacccctgaaggcaacaacaaaggcttagagtgaaataaaaaagttcgcagacatactgcagaagatccagtctcagagaatgatctgcttaacacttggccctgagattatctgagaatttcctaaaacattcaacacctcacagtgaccacagttaaaaataatgtattataggtttcaaaattgctaaaagaatagattttttaatgttctcgctacaaaaaatgataagttggtgaggtgatagatatgttagtcagctcgactgactctttctacaacatacacatagatcaaaaacatcacgttgtactcggtaaatatgtacaactattatttgtcagttaaaaataaattaattaatttttaaaaaacttcaatacttccaagatctgggaacaactacgtggtaagcccattaatttataactgggactgtaaaccaacagaacgaattcttccacttaaaatcagcctttgattaatggcatacccatatattacgtctcctatatgagaacaacatataatgtatggtatttattatcacaaaatttctagaaataaaataagtccagttcagtaggtataatcctgttctaaatccccatatgtctataatgctgccacatatatcttcttaaaacactagtttcttcatatcacctactgtcattcttataaccccaactcttgataagatagtttccatccattgtccaaacttcatcatctgcctttcatttctcagtacactaagcttgcttctactgaaacgcactattctacaggtttctctctccattagattataagatatttaagaacagaaagactggcttttttacagctttccagtccctagtgcttcctagcactgttcctggaacatagttaccacaaagcaaacatctacttcatgtttcacattgatatataccccactaacgtccaacacgtgttatttaaacaaatactagtctctaaatacttgtacatctgctcaaaaattttataaaatatgctagatcatttctattgtgaaaaattagaagcaaactaaatattcatgaaatagaaatgaaaacaattctggtacatcctattaatatatttatatgcagacataaaaaaatcacattcttatggaatatttaactacgttggaaaaccatatgatatattaagtgaattaagcagcttccaaaactatgtgtatgctaaaatactaaaatgtattattcttagtggttaaaaacctaggctctggagcctgaatgcctggtttagaattccggctccattttataatggcattgtgaccctgaacaagttaatgcatcttgttattgcaccaattttcacatttttaaaatggtctaataacagtacttatattataaaattattttcaggcataaatggataatatttaacatataaggtaattgaaacatgggtatgtaccaagtgctagtaaatattagctatcattatatagttctcaataggaatgtctgtgccaaacaggtaacactggttattcctgaatagcaaaattataggcaactattacctttattgtgtttttctgtattctacttttggcagtgagtgtatattattttgtattataaaaaatcaggctgggtttggtggctcatgcctgtaatcccagcactttggaaggccaaggccagaggggtggttgagcccagaagttcaagaccagcctgagcaacgtagtgagaccttgtctctacaaataatttcttttttaaatcagccaggcgtggtggcacgcacctgtggtctgggagggcaaggctgcagtgagctgtgattaagccaatgcacttcagcctgggtggcagagtgagaccccgtctcaaaaaaaaaaaaaaaaaaaaaaaaaaaaccacaacagattcctcttaaaatatgcaaaatatttactgaacattacattggtaagatgcatacattgttaatggaacaatgctgggatactagatcgaagaagtattgtcatcacgagtagcaagctgcctgtaaaatagtagacattgctctctaaaaatgctgtatttcattagtgctatgggttgaatatttgtgtccctccaaaattcatatgtagaaacataatccccaatgccacagtattaagaggtagggttttaagaaggtgattaggtcatataagcggagccctcatgaatgggattagtgcccttataaaagaggccaagggaacttgtttgcccttccagtatgtgagggtaaaggaagaaggcaccatctgtgaagcagacagaaccctcaccagacaccaaatctgccaacattttgatcttggatttcctgggctgcagaaacagttctgcagcaataaatcttcgttgtttataaattacacagtctatgatatttttattatagcagcccaattgaactaagacaattaggagtaagaagtacgaagaattaccatcattatatatgatgaggttaaaaattatagaaaagatatttctacagaagaatttttaagtggtacaagtttaatacatatataaatatacaagtttagtatatattttatatattcaagtttaaaaactatatacatatatattaaaatttatcacataaaaatacctctctagaaatatcctttctataatttttaacctcatcatttattggaatttgttatggagggagatcgtcccctgctcccttaaagtttatagaaataggtcaatgccatctttcggggctctcccaagactattacaataaaacggggtgtagcaagataaataaaacacacttaggcaaggtgtgctaggatttccaaccactttaacttggcatgaggactattagtctaacagaatgagatactgagaacacatcatcagaagcacttaagcataaatgttctctttttatagtggtggggggaggataacgggagaaatgagtaaaaatgtggtttcagcttctagtttcactaggaacggacaaattagaaagtgaaatgtgagacaatagaaagtttgatgtaattcagcagcactgcaaccatcaattattattttaacatttttggtaaagcttccttttacatccaagaggaccaagtgaaatcaccatgttcttatatttacccatagcatttcttttttatttttatgagctccttcttttgctgaatgaataactatttcagcacactaaaaaattgtgccttagatgtctttctaacagtgcctgtatatggtaagtgctcaataattgcttgataaataatatgcattctgcagttgaggcaaaaaagaaatgacccttttttggaatgaaccaagagagacagaactgaaaaagtgaggaagaagggaaaaataatgaaggaacagaagatgatgtcagataggacttttatcaatgtaagtaaatataattcctatatattaatgaatgtgatatgttacattcatattaaaagtttattaacaaaacatcaccacaatgaatatagttgagattttccttgctatgtgataggtactggtctaagtgatttttatttgttaattttctcatctcagcaatcctatgaggtaggtgctattattaactctatttttcagatgaagaaactaaggaaaaaagagagtcagtgtataaaaaagacagtacaaaaaaagtgtataaaaagagagtcctacagtacagtactgagagaaaatgaaagagttggatttccaacccagaaagtttggctttgagtctgtccttttaaccaaaatattcttaaacatctgtctatattgtctccatttatatatacattaactgaatatttttttaatgtcccttgagttagagaaataatactattacctattcgacaggaagaaacatcagacagaaatgacgtggcctgatcactcagctattatattggcagcaaagcctttctctggcattacttaattcgtattctcacagtaacagcattctcctatccctaattctcagtgctttaggctatttcccaggaacatgctatatagctggaaagagatataagtacaatttgccagcattaataatagggatattgctccttgcatttgctacttctttctgtatctgtctacttttattttttttcttattccctaaacactctatctccattgtgctgattttttgaagatattcatctatcttgattttccttactttttattttctttttgccttggagtagtgtttccttttcttttcatcctggaatagattattgtcatttcaaggcctcccttgtgagtacttttttctcctttttattgccattcttcagcatttttactggtacttataacagttctccttttcttgctggcttctggcgtgggtttgttgctatttcttgttctttgatgtttcgcatatctgattgttccctttctcacccctgctttctgccacgtttacctctttgctattatttgtttcctattttgaaggttgacaactaaggggacagtatcattccttaatgtgtttctccagcttactcatgaaatcagcagcagcctccttcacacataaaaccagtccgggagggcaaagtgactcacgtctgtaatcccagcactccgagaggccgagatgggcggatcacttaaggccaggagtttgagaccaaagcaggcaacataaggagaccccatttctacaaaaatgagccagatgtggtggcgcaactgtagtcctagctactggggaagctgaggtgggaggatcgccggaatacaggagttccaggctgcagtgagttacgatggtgccactgaagcctgggagacagagcgagacccctgatatagtttgaatatttgtccctgccataatctcatattgaaatgtaatccccaatgtttgtttgtttgtttttgagacggaatttcactcttgtcacccaggctggagtgcagtggaacgatctcagctcactgcaacgtctgtctcccaagtagctgagattacaggcacctgccatcacgcccggttaagttattcccagtgttgaaggtggggcctggtgggaggtgatcggagcatgcgggtggatttctcacgagtggtttatcatcatcccattggtgctgtcttcagatggtgagtgtattctcatgagatacggttgcttaaaagtgtttgacacctcccactctctctctcatgttcctgccctggccacatgacatgcttgctcccccttcatttccaccatgattttgagcttcctgaggctttcccagaagccgagaagatgccagcattatgcttcctgtacagcctatggaactttgagccaattactcttttctttaaaaattacctcatcttgcgtatttctttatggcagtgtgagaattgactaatacagccccatcgctaaaaaaaaaaaaaaaaaaaaaaaaaaaatgtctaatcaaagttggaaagtgaacattagggaaatacatattttgtataaataaatcctttggactcccagcttcttcctttgccgatcagctttaagggacagtggttctgtttgacttttgaaaggacagaacaagatccttatatatcacatttctgctatcaatagttaagagtttttgctataaattgaaagtatcatggacacattctttagtcagcagtcactccctgtcattaattaggtgttggaatgatgttctgaaatgctgtttaatttctatgaatttcaagtgggattgcccagcaagtacattgccagcatatgtagtaagtaggtaattttcttttaagattatgaatgttattctcaaaattttaggttgtttttataagggacagtgtacagtttgggcttttgtgttaattggaggttgacaagggaaaaagggatagttttccagcatgctttctaggtttttctaaatagtacaaagatgttcaggaggaagaaaatattgctattttaaatggaatattttcaacgctaacttaagcatatctcagtatttaagcagacatttggatattttcctcatctcagacaataactactatgaccttgaacaaatccctccattttctgattctcagttttctcatctataaaatatgggaattggactaaataactttgtttccatttagctttagcactctatgacttttatccatttacttacacaacactactcctgagaaacatacatttatgcaattatagggataaacacccaggacttcatttaatagattttccttataccaccactgtactgtactggtaacagacactttcccctgtataagtaagctatcctgcagatgctaatggggtgaccccaaaaggccaacagaaattaaagaaacttggcaaaaataaacaaacaaaaaactagccgtggcatacagattaagtatatttacaccaagttatgatttttttagtgacttccccatttaaagttactgatatatacgtgtgtgtatatatatacaatatacaaaatcatcagtatattttcccctagataataattgttaagtataattcaataattgttacatgctgtatacattttaagtgatataaatctttccaacaaacctaaaatgtaagtagttcttttcctaatttccaaaattaagagaggcagagttaagcaacttgcctaaggtcacagtcattaaatagcagcactgagattcgaactcagcaaacagcctggctccagaacccatgcgtctgataactgcttcttataatatggttgtgttcatccattttcttgttcatctattgtgaggttgccagcgtgatttcttcaaaggcctgctggagtcaggaatatgtccctaggtcacagagctcagcaaattttagtagcctaaaacttgactcaattctcctgagcggtactctcagtgtgacctcgctactggtcaaaagttgtaaacgagcagttacatattttttgctgctctcaccaatacatgtcttgctatgtatggccaaacgggttgacttgtgcactcaaaatgcaaaaaagtactataaatatagagtagaaatggaaattggcgacataatatgacaatttaaaaatttaaaatatctgattttcacaagtcttaagagcctcagtgatattcagtatgattggagagtttgaattgtgtaaactttattaagagactagctagaaactcagcagagttttcatggattgcatgacactactttcattttctttgcagtcatcacacaagtaaaattttataggttcaacacactccacatacacctaattgctctctagggtagtaaaacaaccaagcagtgaatccacaaaaacagttcagtgagtttcatttaaaccatgcatacactaccaaaaagtgactcacagcagaggaaattaatttactcgccatgaaaacacaattcttaatgatcccaacactatgacagtacctaaaatttcttgtgtgtatatatttggacacacatgtccacacattttatagcaagaacataaacatttcaaactgaaatgcctaagcaacccttaaagatagcttttgtcaagctaaaatctggtgagaaaatgaaagttaaggcttttattttattttattttttgagatggagtttcactcttgttgcccaggctggagtgcaatggcacaatctccgctcactgcaacctccgcctcccagcttcaagcagttctcctgtctcagcctcccaagtagctgggattacaggcatgtgccaccatgctcggctaattttgcgtttttagtagagaaagggtttcaccatgttgatcaggctggtctggaactcctgacctcaggtgatccacccgccttggcctcccaaagtactgggattacaggcgtgagccgctgtgcccggcgaggcttttaaattggtgaaaatgccaaccattcaatttttactttgaataatcaaaactgaagtgattcaagtagtgattcatcatccagtgtaatctagcacagcaatggagattttgtgtgaaacataccaaaggaaaggtttggggtttttaattgcgtaattgactaattcttgggcacctccttccctcaatcaaagatacatcatctgaatagttcacagcctcccccgaataaatgaaagtgacaggctctgtatttcttaatttgacgcctttcaaagataaggttaatggaattaagtaaccataaagattattgtaaattaaatgttatatccttagatgtctgagttaatttaatgcatttcaataaatatgaggttaggaaacataaaaaggaaaatttatggtactaatttaaatggtacctttccacatctcttgtgcgtgctaaagcataggcttttatgtttgtcaactcacaaatattgttgcagggaagagatagaggtcccaagttgtcttaagaatatggagtcagatgttcagtatgattttaggaacagccatatgaaatgaaatagtcatagctatgaactattgttaaacatcaatagagggagggtacataaatagaagttaatcacaagtaaaataacctaacagtgattatttttattatcataatcatcaaggttagatttacagagcaaaacaaatgcttttctatgttggtttagtgagtattttcacagctatatgtattttagtttttctttaaatttttatatatattaactagaacataatacaaacttcactttggtactagaattacatttttaaaaccattaacgttataatttttacaaggagaaaggtaatgttttgtgatgattattatattattatcaatattggttatctcagaaactgtgcttaatacttttctcatggcaacttatgaagtctttattataatcattttatttataaggcaattgagtcttagaaaggttaaatagatagtataaggtcatccttctagaaaatgagtgacaaatttaaacttagatgatttctaagcttattcttttgactgtagcattatattatgttcctgtagttacagaataatataacacagtgtccaaaaactagaaatcattttattcccttatttagggtagagggctgataataaccttggcaataaaaaaacccaaaacctactgtcacagttcttactgttgatggttttaataaaagaaaaaatgtctttgaggttttccttttatgtggcatctggtatttgcctatatccatgatctatttacagcctctttgaaaattaaccgaatgatattaatagatagtttattttatatagcgttaactcctcctaactttgtacacatttctctgcataatttgaagaataagaacagaggaaatcaacaccgataatacagggaaaaaaatacagttttttttaaaccaagcaagaaaatgcaatctgatgccaaaacaaataaatatgaagaccagagaaaaatctgatatccaaagactggaatctaaagtaaatgatgaagatattagcaatctgttttctgttaaatggattcctctttgttacctttgcacacagcatacattcaaaatattagaaaaaaatcaagtttcaactgtggtttgctttattggcagtaatgtgaaggatcaagtactcaaataatttaagcaaattttagaaataagaggttgtctaatcaaaacacaacctagaaagacaaatattgcatgttctcacgcgtatgtgggagctaaaaaattgatctcatggaggtagaaagtggaatgattgttaccagaggctgggaagggtagtggggagggggtgatgaagaggggcttgtttaatgagtataaaaatacagttagctagtaggaataaaatctagtgttctgtaccacaatagggtgattatagttaacaataattaattgtttatttcaaattaactggaggagtagacttggaatgttcccaacacaaataaatgataaatgtttgaggtaatgaatattccaattatcctgatttgattattacagattgtatgcctgtatcaaaatatcacatgtatttcataaatatgtacaactcttacgtacccacaataattaaaaagaagaaagaaaaacaaaacatatcacaaaggatgacgtagcttgattgatgaattaatagtgtatgcaactaagatgattggagagtgtagaccttagtccatgaaaggaaaatcagagttttcacagagagcaaaagggtgattctatcttgtctttggatttctctccagccatagatgcacacgctcgctacctttgcataccttactccaccatctaaaaagtttccttttatttcaataccactggaaaacccaccatttccttcatcatagattaagaaagagtgggtttttctgaagttccaactaccattgttaatgctttcaatctattgtctattttccatgcttatgattgtgtcagcccatgtgtaactaactcttaccaagttgaaatacgttcactaaggttcttttttgcataagacctgtatagaatagctatatattgaggaattaatagaacagcaatattttttatataccaaccacgagtgagatactatactaggtgttattcatgtatttttgtaacttcacaataatcctccatgttagttatttcatatatgagaaaacatgggaaggctccttccaggctatcttgctaactataaccctagcatttctaaacacaaaatataagaaattcagtgtcttagcactggctattctttccttctggaaggttcttcctcagtttttacatgactggttcctctagacagtcatatctcagctgacatgcctcttcagcaaagattctctttactactgaagctggaataactacccaatcactcactatctcaactcagtttgttctcaatgcaacacttttatctgatatgtttcttgtttatttatcacaagagacataatttctttttcagaaatgtaggctctgtgggagcagggaaatatatataagatccaattacaactcaacaatagataagtcacttccatcattgaagatctgagtttcatcatctataaagtaagataatatttatcagatatggttatcatataatgtatttatataatactaaatatatatatatatacagtaatgtccagtagaaagtatgctgaacaattagtgttctgtaaacaaattttttaagtgcactattctgaaatataccggtctctcatccttctcattttattttttaaaatcattttattgagctataactcacacaccacaaaattcactcttttaaagtgcacaattcagtgatatatagtatattcacatagttatgcaactgtcaccactttcttttttcctttatttatttatttttttgagacagagtctcgctctgtcgccaggctggagtgcagcggcgcgatcttggctcactgcaacctccacctcctgggttcaagcaattctcctgcctcagtctcccgagcagctaggactacaggtgcgcactaccacacccagctcattttttttaaatatatattttcagtagagacgggatttcaccatattggccaggatggtcttgatctcctaacctcgtgatccacctgccttggcctcccaaagtgctgggattacaggtgtgagccactgcgcctggccaactgttaccactttctaatataaaacattttcgtcagcccaaaaaagaaaccccatactcattaggaatcactctcctttctccacgtccccaggccctactaatctactttctgtctgtattgattagactattctgaaaactttatgtaaatctcataatttaaaaaatttcataatttttaaatttttataagttgaaggtattaacaagttaataataaaatacttcttgagagctaactcagggttagctgctttatatttcttcatgctttagctcatataatcattataacagagaaggtagtttctattacaatctttctacagatgcaaatggaaaaactgaggcacacgagtttaagaaactcccagaactacacagttaaaaaatgtagaagtcaggattccaagtcgggcttttcagtcttcctgtgtttgccagctctcacctgagtattgtgttactagtagagggacgtgctcacagtcgcccctatgaggggtatttggatgcagataattaacatcatttcaatccacaaaaataggcttagtcctcaataagtaaggaatcaaggtgagggcactgcagagttagtattttgttgaagacaaattaataaatcttttttttttctttttgagacgagtcttgctctgtcacccaggctgcagtgcagtggctcaatctctgctcactgcaacctccgcctcccaggttcaagcgattctcctgcctcagcctcccgagtagctgggactacaggtgtgtgctactacacctggctaatttttttattttttagtagagacggggtttcaccgtgtcagccaggatggtctcgacatcctgaccttgtgatccacccgcctcagcctcccaaagtgctgggattacaggcgtgaaccaccgccgctggccaataaatcttaaaatattcttcctgctctcctttcttttgtctgttatttccctggatatctactgtgaaatactgtggtctcacatacaaaccaggaaaaatgagagggaggtgcattttatctcaaatacagaacttctaataaaacagagttattttaaatgtatagggggatcaaaatacataaacataaacacttgattatttgatttagcattacattcattgtattcattgcatgcattttattctgctggcaatcaaaattagttccagaagaaggtccggaatggcagttgacacattcccctgctcaatagccctgatatttataattatgatttgaatacattttactgggctagtaaatattaaagcaaatttttagaaatgatgaaaaaattaatttaagcattttttgtctctaaatttacaaacaacaaacatgcaattttctaagtagaataacacacaccagggagtaatgatatttgaaatgactgtgaattttggtctctggatgttcttggcttttggtcatatgattcactacaccttctaggcatgtaattatctcttaacacctcacatcctgtcatacagtatgccattccttaaatgagaattggtctcgagtatcattgtatatttagatcttaataattttaatagaaacatcaaccagtaatttctgaagggcaaaatatataaattttatcacttaaaatatatcttttctttaataaaatctagctcttaaaattctattcagacctagaatgatcctttaagatcatttaactcctataattaaattgcaaaatttgaaatatgttcaacttaaaattcaacctaaaactcaaagctgtattttaaagttcatgttgcacttgttttactgcatctgccagagaatgcaccacaaaatcctttatagatattcagatgaatctctctaccagaaatgaagaaggaacgctgctaatcttgggctttcattggtttgattaccatttcaactctaaatggctgcatgataattagtgggtgtggaataaccagtactgctcaagaagcaattgcctttactgaaaaacaaagtttcgaaagaagcacagtaaactccaagagacaatcaattcaatcttacacacctccctgccatagttttaaatggagcagatgtgctaaaagccagtgagaagacggttgatatttcttagggttcaaacagaaatagaatatccagcacttgactgcccatatttttcacaatgatttattgcagtaaatagtctacacgagcgtcccagttttggactttttccctatcagtcaggtttttaaagccttaaagtagagttaaattaaataaaagaagggatggcttttatctaaaagttagagaacgaacaagaatgttttctagatattaaagtaaattcatttataattatgccatattcagatggatgccattcctatatattaaatgttcatgattttaaaggtcattggacaaaaacactatgaataataaaaaattagaaaaaatgtgaaaaataatgaatggaattatagtagaatctattttaatggatctccatttaactgaatcattagattaaccaaagctctccattccctttgttagatttactatggatcaagatgacctgctgaaaaaccttaactagaaatctctctatgagagataaatcgtatgctttggcggattaaagatagctgcgaatttttttgacatttcttcactggggaggtaaagtctttgtttcctcccttgaatttgggtgggttctgtggctgctctaatagaatgcagtagaatagtggtccccagcctttttggcaccagagactggggtttgatggatgacaattttcccacagactggggttagtgggggggaggtgagggatagtgttaagataattggagactatttcatttatcatgcactttatttctattattattattacattgtattatataataaaataattatgtaactcaccatatcatagaatcagtgggagccctgagctttctttcctgcaactagacggtcccatctgggcatgacgggagacagtgacacatcatcagtcactagattgcctgatactcctcataaagagtatgcgacctagatctctcacatgtgcagttcacaatagggttgtgctcctgagactctaaagccattgctgatctgacaggaggcagggttcaggcagtaatgccagcaatgggaagtggctgtaaatacagatgaagcttcactggctcaccgctcgcctcctgctgtgcagctgggttcctcacaggccacagatgggtaccggtgtgtggcccaggggttggggacccctgcagtgaaagagctgctgttctagtttccagggttaggcctgaagataccagaaacttatattttccgtcttttgtatcattcactctagaaccctgagctcccatgtgataagttcaacaatcctgggtctaccatgctgaagaggccacatgtaggtactagagtcaatagatctagttgacccaagtctccctgtcgtctccaccaaagcaacatacatatgagtacagctgtcttggattctgctgaccagctcatctgccagctgagtatcatttagggatcaagttgataccacatagagtggaaaatcacccagttgacccacgctcaaatttatgacccacaaaatcatgagctataaaaagtgactggtgttttaagctattaagttttataataaattgttactcagcaatagataaccggaacatagcaagaatcaactgtgattgttcccattcctgctcatgtaatgatctaatataattatatactacataatttgatgatacatgactataaaataaagagatgcgttctttctaaaaaatacaaattatcagtaaaaattagctgaagaataaacaggcctttgggagagggatattagaaaagtattgaaggaatcccctcttaaattgttttgcaaatgtctctgtgttctttctctactgcacagaaacgaaaacgtacaagtctctaatctgtaccaccaaatcctcttgattttatgatctcttactactttcttccttataaaagtcagtcttttttttttttttttttttgagagggagtctcactctgttgcccaggctggagtgcagtggcgtgatctcggctcactgcaacctctgccttcagtttcaagggattctcctgcctcagcctcctgagtagctgggattacagatgtgcaccaccacgcccggctaatctttgtatgtttagtagagttggggtttcgccatactggccaggttggtctcgaactcctgacctcaagtgatccgcccgcctcggcctcccaaaaatgctgggattacaggtgggagccactgcgcctggccagtagtcacagtcttaattgctattccttgaacacactctcacctgagagccttttttccactcattcccttaacctggaacaatcttctctatctagttggcttcttgtctcgttctgatttaacctgctcagtgcaactcatcataacacattatttcatgctcttttccaggccctagtattcctgatttcccttgccctactacttttattttccttagcacttatatttcactaacacacaacataacttattaacctaccaaattactgtcctgattgtgggaaatcagagggcttttaccctgaagcaaaccacaacagagaaatagactattttgaagcaaaggtttaggagatcacatatagctgtgaacaaaatatcaacattttaaaactatataccagactattaagaagaactcaaggttttcaacaagggcagtgataaggagaggtcagcatgctttgctatgttatgctgccctctggcatggagttcaaataggccaagataaagccctgttcatgtatttttgaatggataaacaaagtccctctagatgagtacagcgtttgatttttaactacactatttcaggtaacccaaagcttttcttgtctgaaacatataagttatgacaggtctctggaacaagttatatctaaatgccagagtcaggtagtataaggcaaaaagtatacaatccatttttacttgtgtcaccaaacatctcttacattttagctgctgacttttcactaatgtattaatacagaatattatttctgcttttcttcaatttaactaaagaactgaatacttacatttagtatcaaatttctataatgtgtcttcttttaaaaatacaaaggtaattgaaaatatcaattaaatctgaatagtgactagattttatttagatatgagagatacataaatactatggatacaaatcatggtctctgccttcaggcagctgatggccctgtgaacttgtatgtgaagcctgtctggggtcaaattctagctctgccacttacttgtagtcttaggtaagttactcaattttttctgatctccaatttcattgcctataaaagagaattggtgtatatgccaatcatacctcaataaagcagtttaaaaaactgaagaatcaattatttctgaagaaaaaaaagaattggtaagaactcctttatagtgtgtgataattaaataacaaaaactagaacaaagtggcaggcatgggacatggtccatattcagagctaaaagttttctctcactatttttattttcctaaaatgaactagtatttctagaagatacaatgagaataaaaccaattgaaaatattttcttttaataacagtgctttaaaattagcaaaaaaattaaaatagaattttgaaaaaagtaatcaaatagatttgctgtactactgactgtatgttctttacatttgtatgttttgtttttatattttggtatttttaagtattattagtaggtgttcttaaacatttaggtaagatattgtatagttattagctttactattattattattattattattattattagatagagtctccctctgtcgcccaggatggagtgcagtggcccaatcttggctcactgcaacctctgcctcccaggttcaagtgattctcctgcctcagcctcccaggtagctgggattacagggacccaccaccaagactggctaatttttttttgtatttttagtagagaaggggtttcaccttgttggccaggctggtcttgaacccttcacctgaggtaatctgcctgccttggcctcccaaaatgctgggattacaagtgtgagccactgtacctggccagctttcctatttttctaatgagaaaatagtagcttgttgagagccacacacggagtttgtgatttttttttttcttcaggatacgttgcatttatattgtatatcagcgtgtattaaagtgtgtggaagccctctggagatttttacatgtggaatatactagttacttagtaattctctgtaggcaagcggctaagttcacgtatggaaaaccattaagacccattgctgtaacacagacaagggtattactgttaagtgtattgccattttatggtcattccaaacgagaaaagctgcttcattccaggaatcatattgctattataattcaccagaaaacctacactttcttttcctccaatagacagtcacttaaagcaaatgtacaaaaaaaatacaatggaatatggtttaggaattaatgaaaatttaaaaagcagcaatcccattgagaagacagaaggcaatacattttaaaaactgagcattatgcaagggaaaatttgagcagttttcaagttagttctgtattgttctcattaacaaatgtagatggtgcagcatttactacagacaattgattcagacttaaacttttgggctacaaatcatttatatttcagagaaaaaatatgtggtcaaaaacaactaggcagggggcgttggctcacgcctgtaatcccagaactttgggaggccgaggcaggcggatcacctaaggttgggagtttaagaccagcctgaccaacatggagaaaccccgtttctattaaaaatacaaagttagccgggcatggtagtgcattgcctataatcccagctacttgggaggctgaggcaggagaatcacttgaacccaggaggtggaggttgcggagagccgagatcgtgccattgcactccagcctgggcaacaagagtgaaactcggtctcaaaacaaacaaacaaacaaaacaaaacaaaactgtatttcccacaagagacattaaactatttttgtttttatttactaccttaatgttacgcaatttttcaaaagaaaatataatactgtagacgtaaaaaatttaaaacgtatgaaaactgggatatatcaattatcttaaagaagatattcctgaaacatacttaagatttaatattgaaatatataattgtttaaaaatacattaaatattgtttaaagaaattctgttaaaagctgtggggcacattatgaaggcaatactcacttctttacctttgttataaaattaattttgtccatcaatttttcatcaatcaaggtttatctatacacttgaaaattcaaatccacagggatcttgaaaagatagcatagatagtatctttctcttttaatagatgaaaaacaactgcagaaaggcacagacatcttcagtactaaataagtcatacgatacaatatgtctaattgatataaagaaaaggtaatcttgccatactgctccttctggctagtttatttctaaagctatatccaagaatcttgctaaaaatatcagctgtgttattttcattcaatctatttctttcaaacattctatttttcaaaattaggtttcatttgagcatcagtaactttagaagaaaaaataatacttaaaaaggccctggccaggcacggtggctcatgcctgtaatcccagcactttgggaggccgaggcaggcagatcatttgaggtcaggagatggagaccagcctgatcaacacagtgaaaccctgtctctactaaaaatacaaaaattagccaggcgtggtggtgggcgcctgtaatcccagctacttaggaggctgaggcaggagaattgcttgagcccaggaggcggaagttgcagtgagcagagactgcaccattgcactccagcctgggcagcaaaacgagcactaagaaaaaaattagtagtaatatgcaaagtcaggtctcagagctcctgtttcttctaaattaggtgtatctcctcagtctttgaatttagtctaaattggtttataaataataatcctgaatctttctagctccctgccacaaagatggatatttagatatactatggaatatttcactattcctgttttatttctagattaaaaatcaccaaaacaaggagacagaaattttatatcttccctgaccctaatttttccccttgaaatcttgctatcaattatactgacctttggttgtaggcatttctttatatttgtgtttttttgttgctttctacataaactctattcatggggtcttttgccaactcattatattatcctttcagaatatggtcaaaggcaagcccattttacaatccaattgtcatttctaagaggatattggaattactcatgtacagagtaaaaggttattttcctcacctcctacttagcaaaagaaagtgaaaacaatgacattcttatttttagtgatttaattacattttcttatccatgtgattttcttcatctaatttaacaaaattatcagagacatggtctgattacatatcatctttcttattccagaagtacaagacaaaactaaccttgatttctgcttataatcttacattctccccatggattcacacagctctaccctgatttgtggctaataacaacaattttaattttcctattcttttaatgaaagtaatattcctctcttcttctctgaaaaatgaatgcctttatgatttgggagggaaaaattctcctttggtgttttccttccccttcagttgacccacactattaataatcttcacaatatcaatcattgttgcagcttagacatagacaatgtttatgagcctttctctttttttttttttttagacagagtcttgctctgtcacccaggctggagtgcagtggctcaatctcagctcactgcaacctccgcctcccagattcaagcgattctcctgccttggcctcctgagtagctggaactacaggtgcccgccaccacacccagctaatttttgtatttttaatagagatggggtttcaccatgttggccaggctggtcttgaacccctgacctcaggtgatccacctgctttggcctcccaaagtgctgggattgcaggtttgaaccactgcacccagccagcatttcaaatccagatgctaccacaggaggctctgggccttaaagaaatgcagccagctagccgggcatggtggctcgtatctgtactcctagcattttggaaggccaaggtgggaagatcacttgaggcccagagtttgagaccagcctgggcaacacagggagatgccatctctacaaagaaaaaaaaaaaaattaaccaggcatgggctgaaacaggaggatcactttagcccaggagtttgaggcttcagtgagcagatcgcgccaccacgcttcagcccaagtgacagagcaagacctcatttctaaaaaataaataaatgaataagaaagaaatgcagccacttggaaccaatgctgtttttcagatctttgagcctctcagtaacattaattaagaaccctggtaaataaatatactaaccagtggcaagaataattgactgcaaatggctgaatgttttattattttcactttttttaaatagaagtttttgacaacataaaggccttacccaaaggaataacaataataatgaaaagagcaagcatccattgtgttcacaaaatcacagaatacatgtacatcaaatgaaaaataatcctttttcatctctgagaatactccaaaacttgtccatctgagtatcaatggaaaatcttgctctttattaaaaggaattcttcactaatgttcagaaaagctgaggaatgtacttacatcactaccgtcactactagagtatgcactggtggctaaaatgtcctaacaacttcttcagggctcaaatattttagggctttgaattcaaagatgtgtaaaatagagtctctgtcttcaaggactttataacttctatgcatatggtatgtgctagcgtggatgatggaagagttacatttaaccttcaccatggcaggaagatttattgggggagataaaactttgaagataagcaagagagccagattaaaaataaaacaaagtagaaggaggaaagaatgggtgtttcaagaaaaacaaatataatgtgctcttgctgatgggtaattctttgtgtattttcatactcctatttagtgtgtacctatttttctcacagtatatcgaaatacgctattatctgacttcctcgggtaagtctacaagaccaaatatacaataacaaatctattgagaagatacagttatttacatgcacagaaggttattgtgagaaactctatcaaatgcccttgctgatattggcctgacccacaattcaaacgtttgggtaccttcaagaaaatgtctgtattttttaatgtcctttgaaattattactctagtcatgcattatacgataaaagatacacgaaactgatgtccaatggaacagtaagctttgacagttcacattctttatagataataagatgtttaaattcatttccatgatgtattagtttcctgcggctgctgttaaaaagtactacaaactgggtagggtttgtagttgtttgtttgttttttaggagaaacatattgtctcccagttctggtggctagaagttcaaaatcaaagtattagcagggccatgctctcactgaatactctaggagagagtctgttccgtgcctctttcttagcttctggtattgccagcaatccttgccattctttggcttatagacacgtcactcgggatagcctctgtcatatgggattctccctgtgtgtcttctctgtatttcttctcttcttcttataaggacatcagccatgttagattaaaggcccaccccactccaatatgacatcatcttaactaattacatctgcaaagaccccatttgcaaacaaaaaccacatttttgaagttccagaaaagacatgaattttgagggtgcactatctaacccagtgcacgtgataacacaatcctcaatgaactgactgctgtcaatctctcagttttcaactccactactcaactactacatccaacttagcagacaaacaaatatatgtattgaatgagaaacagtccctagctggtaaaagtaaagtagggccaggagcggtggctcacgcctgtaatcccagcactttgggaggctgaggtgggtggatcacctgaggtcagggttggagaccacagccagggtaacatggcaaaaccccatctctactaaaaatacaaaaattagccaggcatggtggcacactcctgtaatcccagctaccctggaggctgaggcgggagaatcgcttaaacccaggaggtggaggttgcagtgagctgagatcgcaccattgcactccagcctgggagacaagagtgaaactccatctcaaaaaaagaaagtaaattagagagaagctaaagagtaaatcaggcaggattttctgggcagagaagtcatgcttggctataaagctatgaaagtacacagaaatcaaacatagctcatttagatcaggcataattattataataaaaagtcattatcttatggcctcacataatattattgcctatatatttctgtgttggtccttcataatacttggatttacatgcagaattgtatatttctgtatcatattttaagtgctctgtaatgcattaattatttgctagcctcatgtaggctgcagctctccagcctttaagttcagtcatatgccaacctgaagaacgtgagggattgagagagtgtcttaaatgagagaagcccatggtggccagcttcatcagaaacctagtgtggctctggttttcgccaggttctttgttccttgtgactcattctctgccttgcattgtctattcggtcccctcaggcctgtcctagctggaaagagctctctttacttcctgatcccatctgttccttgacctcccctctgacccaccactgggcatgctcagaataggaaattgtgccataatagataatcctgacactctgttccatttcttcatgttagttaattaccattcaaggtcttgaggcctacattaactgctcttaaatgtcaggtctatgtacctattgcctgttatggagcaggcctgttggtgaccaaagcagcataacctagcatctgttgctcagatatcatgtcccagcaccccaattaattgccctagccctagtctagccagtcttcagaactgaatcattatttatttggtctgtatgcaaaccaaaccccatttaaatcacattcatctacccaggactctcatttatcaatcaaactgacattttaaatgtcagatgagttatggtatatcctttgagtgatcatgataacattccctcatatttaggagataaactgtctgcatacatcaatatttttaaacaccgaagtaagtgtcaaaggtctgaaaattaatgatgaaatttatcacttcagtattctgcatgcttaaaagataggagtcacacctaccttccaataacctattataagagccaaaaatgatagctaacattcaaaactaggtatctatcatacaacaaatattttacaaatatgttctcatataatattcatatcactgttattttcccacttcatagacacgggcttagtgaaatttcataactttttcaacattacaatgaaaaatatctgagtttctttagtggctttgcctgttgcagacctcaattttttttttattatactttaaattctgggatacatgtgcagaacatgcaggtttgttacataggtatacacatgccatggtggcttgctgcacccatcaactcatcatctacattaggtatttctcctaatgctatccctcccatagcccctcacccaccaacaggccccagtgtgtgatgttctcctccctgtgtccatgtgttctcattgttcaactcccacttatgagtgagaacatgcggtgtttgttttcctgttcctgtgttagtctgatgagaatgatggtttccagcttcatccattttcctgcaaaggacacgaacacatcttttttaatgtctgtgtagtattccatggtgtatatgtgccacattttctttatccagtctatcactgatgggcatttgggttggttctaagtctttgctcttgggaatagtgctgcaataaacatacgtgtacatgtgtctttatagtagaatgatttataatcctttgagtatacacccagtaatgggattgctgggtcaaatggtatttctggttctagatccttgaggaattgcatacctcaatttttaaatacaatttaaaaatacaatcaattttttatctatatcacattcaggcctacctctaaagtatataatgacaatccccgatttacaatggttccacttacaattttttgactttgcaatggtatgaaatagtgcacattcagtagaaaccacacttcaagtatccatacaaccattctggttttcactttaagtacagtactgaataaaagatactcaacactttattataaaatagaatttgagttagataattttgcccaaatataggctaatctcagtgttctgagcatgattaaggtaggctagtctaagctatgatgtttggtagattaggtatattaaatgcattttccacttataatattttcaaattatggtgggtttattggaacataaccccactgtaagtcgagggatatcagcaacgcgtttaggaaaaatagaggcaaagtgtcctctagggtggactcagctaccagggccacagcctagtcagggacactgcctttatgtgaaggaaggctctacttcctcagggcagacacaatcccatgagtgtgtcttggatgcctttacaaagggctggatttcagtcctcacctgccttctcagccgagcatgcctgggcatgcaaaaatagcacaatggtacatggaacccttaaatacattccattaaaacaaatacataaatttggcagggcaaagttaagtttagaaatctattattcaaaagccagcaaggattctaaagtccttcagtgatcttagattgcgatcttttgaagaagacattaaatatgataccaatatctgacctcatttatcaagaggaaatgtgagtttctctcaaagggtgttgagtagatatcacgtgtttactatctctaacaaacagaactcatccagatgataatcttggtcttgcctgccggtgatgatctagtaaacttatagacacagcaattttttagcaaactttaagatagtataacaaaatttaaagacaaaactaaggatttttaaacctttaatcttatttaaattagaactctatcaatgaattaaatgtccaacctaggtgttaaaaattctctattactctaataatttctccccaaattttgtaacatattcgatattccagaactctttgcattgtaatagcattttgttgcatatgaaatacgtcacgtatctcattaaatactaaagcaaaacattaaaggaaaaattactgtcccaatcctacagatgaggaaattgagtctcagtatagttagatcatctttctaagggaaacacaagacttttgtctttatcaattagtcacatcatttatatcatttattgagcactgttctaagggtatcacaaatggcggctgctctttgaatcatcaacagtccaacaaggtgtaggtgctgttattttccccatgtttacagaagaggtagattgaggaacagagaggttaaataatgtgcccaaggtcaaatgctggtagagaataaaaccattttttatgtatgagtgcctatttcttacaaaactctttatatatattatgttcagtattttaggaaccagaaagggtgatattgttattcccattttattattgataaatctgaggttgagaaaggttaaacaacacaaccaaatttacgtgactaatgagtgacaaccaggaatcgagcccaccttttgctgtttctgaaacatgtattcttcccagaataacctttaatctctcaataacagctcatacaattcctccttcccatctcacaaaacctattctgagctctatgtctaccacgaataagcccaagagtagagagaatttatctcacaaggcttaccgtataccccttttcaataatttttatcacattatttctctttctcttccttagtcaacaacatttaatttactcctgaaactatccctacactaatctgaagttgttaaattactaagttattttgcattcatatttccaaaattaattgtccaagttcatctctcaaaatgaaataatttcagctagaaatgagctgtggcacagtaagcctttggatggggaaggtaattataattgttctgtaactctggttatggaacatgatctggacagtgagagttggatagagagggaagccactgggggtagtgtgactaagacactgttttagaatctgaggatatgagttcaagttccacagctaacacctgctagatttgtagtctgtaagttgtcaaatttcaaagaatcttatattcctcttggataagagataggtaataaaaactacctggcacagatggttttgtagaaaatccaataaaataactgtggaaactttgaaattttcaagtgccattaaaatatcaaataccaatttaataattagcttatgatcagatggttagggacgttgactgccgaagtgtatattcaaatcaatgcagtataggctttaaagtagggccaaagcatgaaatgcattttaataagtgtacacttctaggattctttgaaagttgaaaaaataattagtaagaaaatggagatgaagccctacactaggatgatagcacttagaaaaagataaaagtgaatagatgtgtcaaaagcagatttaatgggaattgacaaaaagggacgaatacttgaaactgactcaaagattttgagtctgagggattggaagagtcaggggactgctgttggaagagtgggagcaaatagaatcagaaaacacacgcacacaccaaaaataactggttttggatattttgagagccatagcccaaaagctaaaggctgttctatgttgaattatcaaagccactttctgatctctgtttttatgctgtttttttttttagcattttcaaatttttcctcacttaagattctgtaaaatttttattgcttatatgcttgtgtaagaaattcatatcatgtgattgtgctccaaaaatttttagtaggataatagcattttactgcttctgaaaatgacctgcaatattaggttattatttgttatattaggtctagaaacagcataaactattgactgaagtttgacattttaaaattctctaataaactggaggaaagtccacctctgctggaactctgcagtgcacagaaggcaaataatagactgctatcctgccatggcttcgcttaatacaaatttgtacaatatatacaatttaaaaatgaattcataacatttctattttctcataaaacattgtgatatgtcaggccagtaacaggtgtgaaaatgatggaatcaaatcctcacagaatacgtgtttagaacagacctcttcagtaaagacaacttttaaaaatacaggccgggcacgatggctcaagtctgtaatcccagcactttgcgaggccgaggcaggtggatcacccgagatcaggagttcgagaccagcctggccaacatggtgaaactccttcactactaaaaatacaaaattagccaggcatggtggcacacgactgtagtcccaggtacctgggaggctgaagcaggagaatcgctagaacccaggaggcggaggttgcagtgagccaagatcgtgccacggcactccagcctgggcaacagagtgagactccatctcaaaaatatatatgtgtgtatatatatatatatatatatatgtatatgtgtatatatctatatctatatatatctatatctatctctatctatctatctatctatctatctatctatctatctatataaagttttaggagaaatctgctcagaattgcattcctctcttactcatagtgataaggggacctcgtagctaaaaagtcttgtagaggaggttaaaagttcttcaaagtaaaaacattctcaactccagaaaacaacatgtaagtcaacccactcatgttttctaagccaatatcttagaaagttgttgtcgactcctcatgagcctctgctacccacagccaatctgttgctaaatgttgtgaattcttttttattgtattgtatgtcttaataacttttttcttcacttgccaaaataaaatccatatgctccccccaccctactgcatggttctccagtaaagactatagatattttttctgcttatttatatatattaaatagatttttaggcagtaatttgaaaatcactttgtctctttgaagttgcaaattgttatagaccaaggctggttcatgcccataaaggttgtttaattaatcgaatttgatatgacagagtattacacacaaaatagtggacggaatatgcacaaaacaagtttttcacaaaaggaagtgaaaagcttgtgccaaattcatctgtgtaacactagaaataaatattttaaaaatatatttattgcttagtttaaaaaactggccatttctgagctttaagctatcattggaagctttataatttaaggttttatttgcttgctaaatataattgagctgtttaattgtaatccttagccttggctccttagccaatgtagagcttaataaattcacctttagattatcaataataaacacacatggtaaaatctaatattgcaatagtccgtaaacttccgggcttactttctaaaagcagataagcagagttattgaagaagaatcgtgtgtctatatttcagaggcataaactcattttaggagtcattattactacactactttcacagcatacctttaatcaagtatcagaaataaagtagaacacatcagaaaataagtggtctgataaacaatttaccacacctgaaatgcagactttcatacgaaaaatgttctagcacaacagggtccacaggcaatcaacaatcctgttctcttccttctcctgggctgatctattagcatggctaatagatcattgcactctcctacagaggccagatgggacttctccacattttagttcaagaagatactaccaattaattagagttggcacttgaggttattatttgctttgctttacttactttctttctttttttttttttttgcatacagacttagacagctaaattaaaatcatattgaacatctccttcaatgtgatattaggacatttctagaagtgtttacttgaatctacagattttgagctataagggacttgagtttaggaatttagtttaaatttgactaatagcatacagttttctacctcagcctaataaactcactgactctaataacgaatttgaaaaacaacatgtccttagcatcctgacaaacccacagaactgctgctccttcctcctacatgtcagtttgggtttcagcattgcatgacaaaaatctcaattttctttatgtgttagaagttcataattggaagtgtgaataaaagttaggggaaaaatgacttaaacttcagcagcaggaaaagataatctttactgtctgtctagttttagagcatccaataaacaagaacatccatcaaaaaactctttggtggcttgaggaaatgtggggagtgcctgagtatcacgctatccttcttgtgaaatttttgataatacatgtctgtagtaagcatgattcacaactactaactaaacaatttataattccaacaatttcacctaaattacacaaaggtgtgtttagaatatacaggagaatagccagtatgaaaaaaaaatgtattcagagaaaagacaaataatacagctcaggaatgaaatgtttctcagctaagggacgacataggatcacaattcatctaggtgttttttccgcagttgctttcagtacatatttatacaaacagaataaaagaagtaccggaaccaaataagtagtaaacaaagggggaaagagatgattttgtaatttgcaatgctcatgcacagaaaataaaatgaaggtaataatagcacaaaaagaaaacaagggcatcaagtaagaagaggaagaaaaccaaaacacacaggacaagaagatggggcgttaaaacaagaaagctctagtggagcagtaactgagggtaaaggaagcgctcaagttttgatgtataggaagcaaagaaggtaactgaaagtgattaatgatgttgttttggcaacagaatagcagattaagggcagctttctgaactgattggaaaggatgctgaaggaaggaaaggtgctcagtgtgggaaatcggagatggcaggatacaggaataccaggtcaagagagatctcagtagtatattctaggttttaaaaatataatggagtgattgatatagtttgaatagtagtctaggtgttagaaagagacacagctcaacaatatcattatcaatcatcgctgagaaaaggcaaggagtaatttaacaggaatgataagcttacaggaaattaaaagtgaaataagatatatgagaagatgtgagaaagagattaacaggattattctttaaaacatggaagtaaatttgagaaacatttccctttccaaataataacccatactcctaaattaaaacttatggtgaaataatacagcataattttctacatacggatgaattcagtaaggagaaatacttaatttctaaaaattgaaagcgcaaagttattttgatttgtaaagttttcagatcattcctctattaaatatcagtgactttgcttactactttttcaggtattgtggggtatgtatccaaaaaagtgtgttacctgatttatgcatttatgtctattttttaaaacattgcttcttctataatttctcctcttttcagttcaaagaatggaatatagtacaaagaaccttgaacaaaaagtcatggctgggctttatttctgaatatacatacatacatatatatatatatattttttttcctcagtgtgtattcattgagtgaacctgaatgagcaatttaaactgtctaggctgccttttactagtctatcaaataaaagaattaatttctactcaaataaatctagaaggctattaatgggatattaacacatttaaaagtggtttaaagtagaaaaagcaccatcgatatgtatcactgatttgcttatccattccacaaattaagtacctactatggagcagatgctgtcttggttctgggacaacatctatgaatgacactgaaattgtccctgctctcctatcaggtattggtattattaaaaactgacgtatttctgagaagtcctgagaattctttctgtagtaggaaacaacgcttgaataatttctgctgaagaacatttaaaaacacagttatgaaagctggagagtaatccatattattgtccttgcttcagtttatttttctattattattttatgcattttaatgtaggtaaactaacttcgatttaggtctttctccttgcacaacttcagggaggactgttcatagaaaatataacttgaaaattgtgtccttgaatttatgcactaaatggtactgcttcaattcatattcttcaattcgactagtaattatttgaaagatttttaactttataatttgaaagaaattagacttatatgaaagttgtaaaaattgaatcacatattctaatgtatccttcacccagaatttttttttactttatcttaaatataatttctttttgtctgtattttagagtcaatttctactcagaagaacaagtatataatgaaaaactgttaaaatgtgtgtggcacagaaaaatgattttgagagtaaaatttgagcatggaaaagaagatgacttaattattatacttatattcaagcacaggggaccaaaacttttctcagcaatatcatgtctagtaagagcagaggaaaatatttaaaagcttggacttgggaacaaaatggcccagagtcacttcccatttaccacttatgaatggtgtggccttcagcatgctcattaaccattcagtgtcttaaattccttttgtgtaaagagagaatattatcatatatcatttaaaggctttataaagattaaatgagttaatatttataaagtgcttagaaaaaatgtctggcacacagtaagcaccattaatggcttgataaaagtaatttgacaggtaaaccaacagtactctttctattttgtaatgtcaaatcatggctacacttgaactctgagataaagagaaagattgggggcatggaagagtagcgtgtgtgcatgtgtgtgtgtgtttgtgtgtgtatatatttaggtgttaaaatattttatctaagtttccggaattctgcacaatgtagtgaaaataaattggtaaaatcacgtttatggctaatggcaaacatatatacaatgtggcaattactacttccaaaatactgttgaacaaaaaataactttatttactatatattttttaacatcagaaagaacgttgggatcctacaatcctgccaaatcttgattttgacctgtatggtactgggattgtagtgggctcaggtgttttgttgacctttgaattattagccatactctgaaagttgtttttgaaattgaatcctagaaaattcctgatatatagcttttttttttggaaacttgcattcagataatttgggtcttaaggtaaatttaaattaaccctatttagaaacgtcaaggaaattaaacatattaaagagatattggtgtcacatatacaaacttacatgagccttctttaggaagaagcaagcagataaatgaaaattagaaaaatattgaattgtggaaaacagaagtcaatgaggaaaaattagtaattaatccaatgtagtactctgagatcattgatgatgccttgagtgtggctgggagtctacctggattattgatggggagaaacttttgatgatcatggtgacaaaatcaaagagaaggcgtaaaggatacagttatattccctaagtaaaataattagttataggattgagaatttcaaataaaaagcaatatggaaaagcatttattatataaataatgtaactggcacagaacacagaaatgcatgaataccttttgaatttccaaataagatagattcctgtcaactctctagaagataggtttttttttttgcctctattgattctcttgcatgcacaaagtctttgaatatttgtttctcatcagatttaccttcaacagtattggggcctcccaattacatacatgcttttattacccaatgaacagaaaaaaaacaattactgttcatattatttcaactgaaatcaagcttgttaaaagctctctcacaattgttaattttgtacatttgcaaaaatcaatagctagaaaatttactagacacgaaggcctctgaaacaatacaaatgatctttatgccctagggctacgaatttattgataaggttaacaatccttgggtaatgacagcttacttctcttctgaatctagcctaaagattccattaaatatatttctaaacaacaaaaatgtctagatgagagtctaaactgatttcaagtgtttgcttcaaaggacaaaacaaagacagatgctcccttccagccaatgacttagacaatccatattaaagattgaagtcaatggtcatgatatactaggttgggcaatctggcttgaatgtgacattgactggtttaaattttgaattaatgttctctcaaaatatttcatccatcagttggtttatttacacttattatttaccaattactgacataggtgctaacacgcagcaaaaacttttaaaattatttttatttgtatttcctttttaattttaatagctttaggggtggaagtggttttttgttacacaaatgagttctatagtggtgaattctgagattttagtgcacctgtcacctgagtagggtatattgtacctaatgtgtccttttttttaatcgctagcccccctcctagaactcttgatgaattcagaatctagggagaaagtcagaaaagcaatcagtcaatacaacgtagtacagaggaaaatctctgaatagacttccatgtaaccaatgcctactcaggtaatttgccagattaacaaacaccctgcatttcctctgaaaagtacattggctaatgcccagggcaagatggatacttttaggtaatactcaactcattggtagacccatgaggttccgctctcacaagttgagtatgtacccaaaagctaacttagttaagccagttataattatttctagagttacataaagattatcaactgaaaaatgtaagctccatgaagacgagggctttgccgttcccaagtaactagactagatcctgcttaatatttattaagtcatacacttacaaaagtttttatttatgcaaaatctaaactgaatgttgtagaaataatcaataaatatggttgcaaaatgattcaaatgcttggacagacaaatgtaaaattttattaaaaataataaaaatctttagttctatgtgcagattgcttcacaaatatcttttatttctcattcagatataaagaaactgaaactggaaattatagattatgctagctatgagcaatagaactatgatccaagccacataggtaattttaatttgtctgatacccacattacaaataatgagaaatgggtaaaactaacatccatactgtattttacttaaccaaacagatcccaaatactatcatttcaagatgcaacgcatataaaattattattgagatctttcatattatttttacactaagtcttcaaagtccagtgtgtattttacatttatagtacctctcaattcatgctagctacattccaatggccatagatggcaagtggctaccatactgaacttcacagaagtagacaatatggatgtgatttctgtaagaaagagaaaaataatctcactctaatctgtgaatttctgtagtaggtatgaggtctaggtctatgtacattttgtttgtccgtggatgtcccattgatccagcaccatttgttgaaaacactactcttcctccactgaatttattttgaaactttgtcaaaaatatgttgggcatatttgtgtgggtatgtttctagactctttattctgttcaattgatctatgtgtcaatccttctgacaatataacacaatatttgttgctgtggttatgtggtaagttttaaaatcagatcttattgtataagcttaacaacatataatgttactgaaatgataacttccgcaatttggggaaaaaacagaccagatggattgaacactcctttaaactctctctctctctctcagctgtctaaatgcctcaaaatggaaattcaacagatgagagcttcttattgagaaaggggaagtagtaggggaatctattttgaccacctctctggtttgaaacctctgggggtttaagagaaaaggagattcaagatatggcttagttttaatgttaatgctacagtagtacagctgggacttgtcctacatttactgagaactctaatttacgaaaactagatcctagcattctgaaagcagatttgagacctctaaagctatttcttttacagttttttccacctttggttgcagtctattgtattgtcctgattctttttttcacctactcgtaggttattcttaatcacttgaaaccaaccacttctatgtatatgatttttgcttcctttccctcacagatccctcaggtaccctgtcttatacttttagtaagtcatgcaaaataattgagaaatgagtcatgcaatttattgctgcattttattaaattagagtggtcagatatacttttactgacagagatttggattttactgtcttgaaacagaagagagagcaaaatggttaagaaggtgatgagaaaatgaactgacatttatgtaacagtgccttattattaatatatggttggtgctgtgctttgtaccctttgagagatattttgtgatccaattttatagataggaaaaggatctctaaatattcagttttggaactgatgttctaaccaggtcatcctgacttgaaatttcaggtgattccctcatgatgcatcttgacgcaaacaaaaaatgtactgaatatattattataaatgtgagtaactagaaatgcatgggaaagaagaggggaggaaaagagtaaaaaggaatattaaacaaatgtattcaacaaacctttattgagtgtctattatatggctggctatgttctaggtactggaggtgtggtaacttgggaaaattttatcaacatatattacagtattttctgcataattccccgccatacttttatttcctttgaattcacagtttccattaaaataatttattgagttaaagcctagagcatagacaggcaacttttcaaagataccataataagtttttatttactcatttttgaaagaaggactagtcggatgctggccataaacaggggctaaaatttcatccatctttccatttccaccaatggaggtgtagagttggaatgaagttaagtgaccaagcctcttgagagaggtgaaggatatctcaggaataagcaactagcaatagacaaaggagaaaaatcgaaacagagagaaagaatggtttggtgctgtccattccccatccaccactgccaaacatacttatacaactctggccactcaaactacctaaatgagccaacttcgatgaaacaaacactattgggagagattacactcccgtggtagtatcaagtaagatcttatcctgcatttaacgcattaggaggaagtatttcaccagtagctaaaaacattattagtctaacattaactgtttctatcaaagggatttaattacatgacattaaatagtacatgcacttgtatacaaataatttttttctcaacaaacacagaaataataaaatagagaaaagactaggtgacagatcacatatattgagatacttgccataaggtgagactgatcaacatccttcttcaaggatataaaaatttaatttacttagagggggtttcagaaattactaattgaaagatcttacttaacaaattttttttacattagaaaaaatcagaacttggtaaatcctcttgtcactattagtaaaatcatgttaattagtccaaaactttattttaatacactatacttttcctatacttcagtcaataacttagtttgtggttttctataattcaatcactaagtttatttagagaaaaatatccttaacttggagtccagtggtctttgaatctcccaaaatatatgcaatattttatgtccatgtgtgtacatcatgagtatagattctgtgtttacatttgatttttaaaaagatgcatgtttaccctccaactaaaatcatgaatttattgttttaaatttaaaagttggctaaatggctatgatgtttatgtattttcatcaaaagggtagttgtttgtgttttatttccaagtctatgacttgatgtacaaaaacctttacactgtatcgtaccccaaaaacatactcagattcaaaagagagaggaattagaaaaataatgaaacatttcagtttaaagtgtcttctcagtggcagattcagtgtattcattacttttgcttcttctagagattaaagtgcataatctaatctcataaacagtagctaattcatactggcttaatagaagatcagttgggaataataagctcgatagaatgataacattattactggaattctcagaagaacttggcaatccaagcaagatggataagactaataaaatattacaaagaataaagaaaaagttaagatttatgatagtctatttatgtttctgttattatgtcatataataccataagctgaggtaattcatatagtctgttctacatttcaccaaatcacccttaataactaaacgataaagtgataaaattcaagacactgtgttggaaaataagagggcagagggaaaggagcttggatgataaataataattaactccaatttctaaggaccttaaaatctggttgtcaataaacatcaatacacataaaaattattgtatctatataagattggtaactacaaaaaaaaaaaaaaaaaaaagaatccccagaatccccagaccctgcagaattgggattgagggtagaatgacaagggtcctcacagctgacaatcatgggaacgacaaggagaacaaaagacatttcacacttctcaaagagattactacctgttttgaggatcacttgtcaggagtgcatcttctgtgactatgcagggtggtcaggtaaaaggaagttactacagtaaaggatggtgatgaggaatggtgagtttccaggtcactggaaactgaaagtctcctatgaactcgagaagccgcaaaaccaaggaagagaaagagtaattttataataaatgttgctgtggatttcttcatatctgttttaacacttttgagttatttaagtgtgtgactacttaattaatttttgttattgttgttttgaatgtggcatctacccaaaattggactgcattggtctctgtatttacaaggcttatatttgcatatattaacttaatgcaatacataacaaccagatgaacaatccagatataggggaaagtgattacaccttgtactgggatggacaaggaggacttaattaaggaatttagagaagctcagtcatgaaattagggtaaacttcaaacaagaaaaaaataaaaaaggatgggttgaaactagggtaggattgaaataagaaggaaatagatgaacattagagataatcacttaagtgaaaacataaaattgagaatgccttatcatgaaattcatgcatgaaattctgtcatgcctgttgatctgtttaaaaaataatagtagccacaaatattctcaaatgatcatgcatcgaatcttgtggaccccaagagtaatcatatccctaagggagctaaataacgtatgagtgtagatgtctattgcaatgcagtttttcaaaatgccattgacaatttgttgacttccttcaaggttggcttagctttctttctcagcctccaaaaggctatcaagtttcccatgtagttctttgagatgatcgatctatgttttgggaggagttgcaaaatatatgagatatagccaccttctgtatcagaaggattccctcttgggttatcagaacaatcaaagaagctatctgattactggaggagagactgacataaaattgtagtttttaacttcttgtgaaagttgtgagagcttgacactgcatgcaggagtaacttaagaacaatcttccctctgtggctttgaaatcaccccatgtgggataactacaaggcctgttattgttggaagagctaagcaatagtttaaagagaactagatttgttacaaaaatcaagatggctgcctaaaattcaacatactaggcctatttacgtatattatgcccaaggcacttggctggtaatacaggggctaaacaaagaaagaaaattagttcttgcctagggaaggaggaaaaggaataatttattgagtaccaattatacactatgccctttatatttatgtcatccaatgcacaaagctttattatgatttaggaaatattatactcactttacaggaaaaaagcaccatgaagtgaaaagaacattgactacagagtcagacacacctgagtttgaagtgtggcttagcctcttaatagttctaagaaaggaatttaacctcttcgaggccagttttctgattagtaaaacagggaagcatattaccttctattgtgaaggagcaaataccggctatgctgttttgcagttaacattcatatgaaaggtataagataataataagtaaaatgtattattttattaaatgtatatcatgttccagaccttattatatgctaagacttttccatatattatctcatttaatcttcatagcaaccaggtgaggaggggccaggaatttttccattattttacagttaaggaaactaaagctcagatttaaagaaacctgggtgcagtcaaatcaaaaaagattaagtggctgaaccggcatgagctatatcgtgctctcatctcagagagcctttcgcatagacatctgaggaggaacaaagggtaacaataacagctctttctctgaccctcctgattttcaagccagccccttccacatgcccacttcaacccttgccaagattcttgtgtatgagtaactctgttacctagtctagttttgcatgaatccctgttcctcttcaagcacttctttagcttcaggttttctaatctggaaacttctgtttctgaattagacctgaactaatttaggctgtcaaaaggtttgtgtcttgaaacttcccctgagtcggaacaataaatattgtgcataaatagaaactcagctgaaataaggagaagagttaatgtaaaaaaaaaaaaaaccaggtatacgtataattatattgtcaactaaaaaataaaatgaaataaaagcttcggcttcatacgtggattcagggattcacaagagagcaggtttgcagccacgaaaaagcaagcacagaagtgtgtgtgtgtgtgtgtgtgtgtgcgctcatgtgcacactcaagctgttgatggaacatagcatttgtgagtgaagggatgaaaattagaataggccaggcgcagtggctcacgcctgtaatcccagcactttgggaagccaaggcgggtggatcatttgacgtcaggagttcaagaccagccttgccaacatggtgaaaccccatctctactaaaaatacaaaaattagccggtcatggtggcgctccacttgtaatcccagctactcgggaggctgaggcaggacaattgcttgaatccagcaggcggaggttgcagtgagccgagatcatgccattgcactgcggcctgggctacaagagcaaaactgtgtctcaaaaaataaaataaaaagagaaagtgctcaaaagagaaactgtgtgaaggggacagtttagggcttggggaaaacaaaacaagaatgcgatctcacctagagaccaatttccacatgatcccacagggagctctggagggcaaattgcatcccagagctgatctcaccttgtggcaaatgggttggactcttgtactttcagtcgttggttgcaaactgacctgaggtggggcacatatggcctttcaggctcctggctttcttcagggtaagaacaagtctctggagaaggaagcagctgtgggcaacaagcactcccagcagctaggggatgggtgtgctacctggtgatggggacttcagtagaacatatcagtgcccactagagtcagagagaattgatttgggtcttaaagacagtatacaaacggaaattttattttattttgttttatttatttttttgagacagggtctcactctgtcactcaggctggagtgcagtggtgcaatctcggctcactgcaactgccgcctccctggttcaagtggttgtcctgcctcagcctccctagtagctgggattacaggtgcgcaccaccatgcccgactaattttttgtatttttagtagagacggggtttcaccatgttggccaggttggtctcgaactcctggcctcaaatgatccacccgcctcagactcccaaagtcctgggattacaggcgtgagccaccgcgcccgaccttattttattttattataataagaagacaacataagatctactctcttaacaaatgtttaagtatacaatacggtattgttaactacaggcacactgttgtgcaacagatatccagaacctactcattttttataactgaaacttgatatctgttgacaacgggaaatattttctttagtctcatgatattaaaaatgtatctgaatttatgatttttagataaagcactcatagagactattgggcaaaatacgaacagatgtattgatttctccaagggttccaaactggaattttaaaaaacttgagttaagattcatgcatatttagtaacaacctagtaacacggatgtatgccctcagagaatgggaatcagaatctaaagtattgtcactagagattgaaacaaagctttcaactccaattgttataaaagaaggaattagactattttgacataatccactgcaagggaaagtaagcagaaatatccagtgggatttggaggaaagctgtgtaaagggcgcttcttaaattggacaaaccctttcactctgctggagtccttcctgacacctggaaagaggctggaggtccagcagccattttagacaatgatgttacatcgaagaccgaaagttgcacagaaagatggaaggttcctgggtccttgaccaccatggccctgctctaccggcaatgtactgcttccagctggagctcactcatgtggcaaggcaacaaatctctcttacttaacacacttctatttctggatttctgatacacgcagccaaacccaatcctacctgatgcactcattttttaatactcaaaatgggaactatcttaccattatcactttttgttacacctcagattttcctgaaaaagtgcattgtcaaaacatatcattatttttaaaacaaagagtgtataaatgtattattaaatacattaaaaccagacaaaggctcataaattaatgcaaacgtgtggaatagtttcatcacacaagtgaaaattaaattggactgctctgccataataaagctctgtttgcctgctttgaaatgaaaagcatcatgcaacttttactgctgcgtttctttgaaaagtaccaaatctctcttctgagttgctcttgtctttttgagtataaggtatttattaccactgggataaaaacagaatgttgatggtcacatgatgcaggcagctgggatttcaactcaaggtcagtcactggaccctcaggcagccagatagtgttgtttattttttgccaaattgatgatgcctttagcctttaaataaggagcactgactatgattaaattttgtcctaaagagatatttcacactctaatacatagaatgtatctcattaaaattgtaacagagtaagaaaagcttacttcagagatctctcagaaaaaaattggagtacagcctgaagttatctaaaataatcagcatggaaccatgcagatttgaaatcagatgacaaacatgtactttcaaagcatgaacatttgaaaacagtaacttgcatcagtttctaaacgagggatttaatgtaactatcagaataatcagtgtgagatactgaaatataaaattgaatttgggtcttcagaattagaaacttaacagaaaaaggaggtcattgtagaaatgttacgaaataattttgtttttatgcctaatttagaaattgaatgggccgggtgcgatggctcaccactgtaatctcagcactttgggaggccgaggcgggcggatcacgaggtcaggagatcgagaccatcctggctaacgcagtgaaaccccgtttctactaaaaatacaaaaaaattagccgggcgtggtggcgggcgcctgtagtcccagctactcgggagcctgaggcaggagaatggcgtgaacctgggaggcggagcttgcagtgagccgagatcgcgccactgcactctagcctgggtgacagagcgagactccgtctcaaaaaaaaaaaaagaaagaaaagaaattgaatgaaagttcattgataatgcagagattctaaaataaatgtagccaaaaataaagccaatcagcataccaaaactattacaatcttagaaatccattatgatttttaaaaagtgctttttttttttttttcctctgagatggagtttcgctcttgtcgcccaggctggagggcaatggcacgatctcacctcaacctccgtctccagggttcaagcaattctcctgcctcagcttcctgagtagctgggattacaggtgtgcaccaccacgcctggctaattttgtatttttagtagagatggggtttcaccatgttggtcaggctggtctcaaactcctgatctgaagtgatctgcccaccttggcctcccaaagtgctgggattacaggcgtgagccactgagcccggccgaaaagtgctatattgctattccctactatttattattctgaaagagacatatcacatgtttaaacatttaaataacgaacaaacctcctgggatcatcatatttatcacgcactttttaaagaaaatcaaacatgcttctgtttatacaaatttattcccattctaaatatttattttacaaacagaatactttcttatattcttgggctacatgaatcattattatcaacagaagggtgtctgtcattacaggaagcacaatacttgtatacttttgagggttactcacacacacgcgcacacacacatgcacacacatacacacagagtttgggacctacaagactttataatcttattatgcctgctacccatttcatcttcttcttcactgtttgtcttgttgtatctctgttcgttgtggcctacccacccctgctcctctctgacagttttgggttgaacttacctggctctggttccaggagtgggtgtctgatggaacctgcccaatcagaacactgtactcctgaactaggttgattgattcaggaatgtgtaggtgatttcttcagagtcaattacaagtaatcctaggtcttctgttggagagaatggtgttttcattttctattggaattgaggtacaatgatataagtctaagactaataatgggtcccatatcgagagataatgtctaagagctttttttttttttttttttaagagcctttgaaaacacagtggagaaagggtgagagaggtactgggctaggtgacatcacttgagatcccaaaactaactgtatctgaagtaagtaatacctcttcactttttcgttacatgagcaaaggaaacttttttttttcttaaactggtttgctaggtttttgtaaattagcagaaatggtgcttacatacacacatatatgtatgtatgtatattttggttgagattaagaaatagagacctaggttctaatgatataactgactaaagataaaattaatccaattattgaaagtttcagcacctcagttgcctctttaaacaatgagttagttagattacatgactgacagttgtctagatctaaaatcattggatccaatcaattgattttcatgaatgaacaaagacatttaaatctggaagtaagttctattaaacctagtatcttgataaccccaggccagataaaactataaaaaaaaaatgactggtctctatatcagtcgatgggcaccattttatagttaatttatttcaggaacatggcagttataacacaggtaactataggacaagctggtaaacctcattgtaggtaatcactgagctcagggaggtagcatgatgtggtggataacagcaagggatagggaaggagaaagtttgactttcaaagtctaattctaactcagaattcttcatctgtaaaatgggaacaataatagctctctcacaggcttgtcctaagtatttactcacataatatacacaaagctcttattacagtacgtagcacaaagtaagtactcaaaatttgccatatgtcattattagctgcggagctattgcactgaccaagtgcttgaaaaaacaaatcatttcctttggcgtgagtgttaatgcacagaggctttgaaaaatactatgtgaaagtcattaaaaaaagaaaacctctcagcagattagcttccttcaacctttgtaagatcctgcttttgacggccaacccagtgctttccacactttctcacacattgcctgttatttctggtcaggaaaataaataaataagtgcccatctggccaagtatttttccacctttatatgaaccagaaataccaattgtttctaatgtgtattccccagatgcaatacttatcctctatttacagctaagccactgattactgtggaaaatattgtcagcaaaccataccccaaaatgtattgctgtgaaaggggaaaaaaatattacaaaacaaaaccctaaaccgaatcgataacagcactcatgtcttggatagatttacagaaagagaaggacgtcgctatttttatttgctaagagatgttgcctttttttatattaaaatatttaaagttacttctctgattgatctgtttcttttgagacataatcttgctctgttgcccaagttggaatgcaatggtgagatcatgactcactgtagccttgacctcctaggctccagtgatcctcctgcctcagcctcctgagtaggtgggactataggcgtgttgtcactatgcctggctcatttcttttcattttttttttgtagagatgaggtctcactctgttgtccagggtggtcttgaactcctgggctcaagggatcctctctctccttggcctcccaaagtactggcattataggcatgagccaccacacccagccactctgatttctgagtcttaatcaaagtagcaaacttataaagtagtgatttcatcacatgccaatattaacaaagaaaaaggaagagtagaaaaaaaactccataactgatactgtaaaatatttttctaatttgcataaagatatcagttctaccctagtatatttacaagatatgacaattcactaacatttacattttaattcatataaccagtttgtaagagaaggaatcctatcaaggaaaataagcctacagaaaactaactttttgtgataaaatgattttataaagctgacaataagcatttaaagaagtactagaacatgaacctttaacacatatccaatctactgttttagaaaaaattaagaatgagtttttctgcaaaaatgtatgcaacgcaaattctagtttaaagcggaatatcctgtaatctaataaatatggagatgattttttatagtgatgtaatgggctagattgtacctttagacttatgggaataaaaatattatttcctaatttcaaaactattttaaatcttttaaattctactaaattaaataagaaaataaaatttgagttagccactcaaacaggagatttgttattctgatttaaaaacaattgcctttggtaacaatcactctcaaacagttcgagaaaaatatatgtatgtatatattcatgggcaaggagaaggatttagaaaaggagaaaatttttctaagtttcggtgatcaattggaatgaaagtgtgaaattaccttcagcagtgttgtcaactaaactcagcactttctgtctcaacaggtgcacactcaagcccaccaactctcagctatttgtcaaagctaaggaaaaagatagccagtccccacacagctgcgcctctggctgccactacaaaagaatgaggctcggctatttttaggtttggggtaggcaatcagccaaatctcagcagcaccacaagagcatgtgctgagataactgagactttagagttgaaccaggactccaccagcctcccaacttcctgcctagacacccaaccctgtgttctcatttctgtggtcaccaagtcacctgtggctttcatcatgatccgcgaaatctacatttctgtgcttttcccagctcctctcctgttacaactttcatttcttatctctagaccttgaagccatgaaattttccttattagttcctttactcaacaaggaaaaaaaaaaacctcagaacactctgcagctgcttctataaagaaagcagtgtgggtttaatttgtttataatctgtccttcatttcattaagcctctaagtcatggccattgctaccactgtgcttaaaaacaagagaaaagtgaatgcttataaagagtggcaggtacaataactgatgtacaaagaaggaaaacacagattactgtgttttgatagttaaaagggagccagaatagggagctaaggagtctgatatcaatagcgtacattattttacctttgttgaatgctgatccagaaggttaatatgtctaagaatgtgcatttgtgaaatttccctatgtgctagcataatctcactaggtgttgcatgatttccatgaggaaagctgggttttagtggaataaattattctacattagatttttttgtcttctcataactgttttttatttgtaaacaaaagtacatgcacacatttacggtatcctcaggtattgctatcaaaacagtaataaaataacgcactattcttttttaatgatttttttttgttgtgaactgacatgagctttcatatacgaaatccgattttgaaatataaggcacatttattttgaaattaatagggaatctaggtcaaacaaagcaaagccaaaccttaattttacagaactgttctacctctacaaaaagtcactcaaaacaattgtttaaattgtgtgcaataattatcttgaaaatgcattttaacatgttcctataaatataattccatatgactaagatgaaaataataaataaaataatagtggaataaaattgatactttatttcctattttgattttatccccattattccagaacaaattcaatatggcagataaattgcaaggatttattttttctttctttttttttttttttttttttgagacagagtctcgctctgtcgcccaggctggagtgccatggcacgatcttggctcaccgcaacctccacctcctgggttcaagcgattctcctgcctcagcctcctgagtagctgggattacaggcatgcaccaccacgcccggctaatttttgtatttttactagagatggggtttcaccatgttggtcaggctggtctcgaactcctgacctcgtgatgctcccacctcggcctcccaaagtgctgggattacagatgtgagccaccgcgcccggcccagcaaggatttattttcagggagccagtattatgcagagatcagcctgctttagaaaatacagtgtctctcatgaatgagtgcaccatttgccaaaaataatctattgtatcttcttctcaggccaataattaaaaatgtattatactccaaagaaaaacgtaaataaaaaagacaatcctgtaaaattatatggttattgtatctctacaaaaacgtttttaatattgtaaaatatattatttacataaatatgtaaacattcaaattgaggagcaagttttagagtagggctcaaaatctcatatctgccacttattagttatatggccttgagaaagttacttaagcactgtgcttcggttttgttttttaatctctaaaatgggaagtattctttcctcatgatctggttctgaaaattaaatgaggcacaaatattcacactcccccagggttctctaatcctttccttgatagtgtattccctccgttagaaatctcgttctcttctttaacttcaactatcatctatctccatgtaagtgattctcaagtatttctctcttaagtctaactctttagttttagtcctcccccacaaaaacttttattatctacccacctggatagcccatcaacaattctaagttgatgtctcaaaacaaaaggcccttttccccttcccctccaattttgatcctattcctggtttctctacttctgttaatgttaccatcatctcaccagttcctcacggtgattagctattaacaattttaagaattccaacatatgcttcattaaacattagataaatgggcatttattgactgcatgttaaagaagttccatggtgaaatgagtttgggaaactaggttaaaagttaaacagctgtctttcctgcaggattccagagcatctttgcatatgcattacattgagaaactctaaggggatttagtatgtagtattcccctcagttttatgactaaagaagtcttttttgggggcgtggggccaaacagagggggcccataatgaataattactgtgccatagagcactcttgggggattaatatcagggagtctgctatcattattcccttttcctcatctcccacaatttagcaacaacttactaccaaataatttggttctccttgttgaatccctatctcattctgagctactgcttttgtaaatctggcctaggctacatgtaggctctcctttcactgccttttcttattctaacatctcaaactctcaattcaatatcttctgtagaatttgagatctattttctgtaagagatacaaagatgggtaagacatgatctctattgtcttgggatctgtgagagatgggaataggccagcagagttcaaatatatattcaataccataggcatagacataccacataaatgttgtgaaacaagaaatagcagtcaatgcttatatgggaaaggttacattaggtttttttaaggaagtgggacctggataatattagtccaggaacttctaaatgaaagatttaaaagtatttatctaccccaaagactatcttctcatcttaaactaaaaataagtttaaaatataattaatattttcacaataaaatgctcactggagaaactttgaaaaaaataaaaatgtaaatataagaatattgaagtaatccagcgtgtaatttcaccctagatacatctactgctaatgatgggtgaaattttattttggatatttgacttgtctacaagtcaacaattctaaagatttagcttccagagctaaagttttctaacaataatgccaattaaatgttttaaaaggttaattataaaagatatgatgattaaatttaaaatatcttgtcacctcctgttcacaacattttgcttttcatttccatatatcttaagtatacatctgaaagctatgtgagcgttgtaaattgtcaagttgaacttaacaaagtatagtttatgttggggaaaactcattaaaatgggatccatttcttaatttccaaaagaatcatctatatgaattgaacattgatttaatatcattgaatattcaatacccatatacacattagaatgtttttatgatttacattgcttacagcacagaatattcaccaatattattgctaagagtagagatatgactcaaaagtatcaatatttaatccagtaagtatgaagctctatgttaattgcaatcactattcataaacaatttgcccaacattgcctaaacatttcttgccattcaagggtttattttttgccttctgtgaattagagtatgatagtaaatggtaataaatgatcttaagtgatagtaaataagtaatttctataacagaataacttttgttctagagatatgtgcaaggcacaatatcactacactcaactgtatccaaagcaggccacagatccttaaagagaaaacttaggaatttactgtggcaacaggagaggaaaaaagcaaataaaaaggaaatgtacaaatgtaggtatgaggaggatgtccttttctaaaaaaaataaggtagtttagcatagttgcaatgtgtggtatatgagtggggcaaaaaatgaggtaggaaggacaaataaaggaccagtaacgaagagcttttgaaatttatttcaggtctgggagtgatgattttgacttaattccctggttttctctaatactgtttgttgttgttgttttctgcatatatagaaaattggtagattttatacatgtgcattacatatgtattggtagattttatacatacacatatatatgtataattacgtatatacatatacaattgttgaatcattaagttgcaataattaaatttattactctttatgatgctgtgggtattacagaagcattgtaaggtactacatggtcctcttataccatagattttttctaaacctacaactgtatagcgtgtggtatgatatgaaaatcactggctgagaactagctgggtcttagttttgtatctaactgtttctgagaactggagtctcactttccacatctatataatgaggaaatggaaaatattctccaggttttctgcagttgtgatgatctatgaccttgttattcactgtagggtgttaagctggtgaaacagcaaaactgcagaccaaataccagttttcctttaaccatctctctctctctctctctctctgtctctctcatcatctatctaacatctactattttaaaaaatcatcagtcttctcaatgcatatcttactttctccattttcccattcttccagccctttgctcttttcggacaccttttatttacccgtctacagttcttttgccctctggtactttgtggttaccagttgctattgtacttcccacaaaggatcaatttgcactacaatcatactgacagcagtcctcagtaactcaggggaaaaaaaacagactcttaagcagcagtggggatccaaagaccatttcccagggaaccagtcgggtcacaggaagagtgggaagagaacagcaaagccccaagttattttcctcttcccacatatttcactcagatgccaatttttgtttgctctcaaagctgttttatttgacagggctccttgttatgggctaaattgcccctttcccaaattcgtctgttgaagtcctaacccccattgtctcagaatgtgactgtagttggagatagggtctttaaagaggtatttaaggttaaatgaggtcactaaggtgagctctaatccaatctgattagtatccttataaaaagatgagattagaacacagacaggaacagaggaaagaccatgagaagacagatggagagggcagcctctgcaaactaaggagggaggcttcagaagaaatcagccctgattatacctagcctttactactgtggagaaaataaatttctgtttaagaaacccagtctactgtggtattttgttatggcaatgctagcaaaataatacattccttattcatttgtaatgttttatatttgaattcagatcattctcattctcccctttgtatatatatatagatatatatccttcttgctgctagaacaataacaaaaagatgattaactgtaagcatagtgttacaatgaactctgttgctcacatgcccttagatatgtatttgtttattcaaaaaaagcattaaccaaataactttatatattaagccttatgctcatctctaggtatgggggagaggtgggaaacatgatgataaaataacagtatccgtgtaacactgataaacatgccaagatatttgtattctcatattaaagtaaataaattgacaaaatatggtgaaagatattgtgcattttgatgaacttatgctatgagaacactttaaaaccatacctaacctccattggcggagtcaatggagattggtgagaggggttaggaaataatttttcctgagatgaagtggaaaccaggctttaattaattaagtgattggtaaggagaaggagggtaatttcaggaagacttatccctgacaacacgaaagcatggtagtttgggggcccgcacataggagcctttggctaaagggttaggagtaagagatgaggagaagggtaggagaggaggtagcagcaataagctgggtcctgataacatgaccttacatacatcacggagttggcattagtctctagcaggaaaaaatattttccaacttttaagttaaggctaattttaaacttgtcacctgtagtaatctctttaaatgaatgaaatttccctgtcttcatttatagtaatcagcatctttcactgcaaggaaatttctaagtgaatgtacattttactcaacttctaatttcctttaggaatctaaactcattcaatattttcacaaaatgataactgtaatcaaggcagagagctttatttcagctaacaaagaatagccctacacaaaggaattgcaaatattctaaataatgactgttataatttatcttctctgttgaaggatactacttcctgttctgtttgtagccatgataaacaaatggtatcatgatccttatagtccaggaaatggactgttttatgtagatgaaatattattattataaaatctgtctcacattccaaacccagcctaggacaggatttatgataactgccccccatctatgctggatatcacactatgatgacgtgtgtatttgtatttctgtgagctcaattcataactatgcaactctcctgaagcataaacttggctacatcaaaatggctaaatatttggtctaatgtttttctttaaacttaaattataagtttagattacataccttaacttacttaaacaattggctggacatttgaaaaaatattgatctttctttctttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggaccacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccagcctgatctttctttctatacatataagctttctgtccaatttataaaaggaagtagtactaatatataatatataatattatatatatatatataatatataatattatatattatataatatataatattatatatataatattatatatatatataatatataatattatatatatatataatatataatattatatatatatatataatatataatattatatatatatatatagtgtacacctatactgccctagtaagaaatcaggaagtcagtattgatgatttgctctctactatttttgtctctctcctcattacccgcgcaaataagttttactaattaaatatctaaatatcttttgtttgcattttgtctttttcattcctaatgccctaaggctcttatctgggatataactgcaaccctcttacacctgcttttagaacagtggctctaaacacaatctgcacttggtgtgcctgtatgttctgatttcattggtctgcaagagttttcacaaaccctgtgtcatctaacaaatagatctgaacctcctcctttaaaaattcaagatgcaaaaataaacacttcttgacaacacatagtttgctttcttagcttttttacttttacttttttttcgttttttttgagatagagtctcgctctgtcacctaggctggagtgcagtggcacgaacttggctcactgcaacctctgcctcctgggttcaacggattcttctgcctcagcctcccaagcagctgggattacacgtgtgcaccaccacgtccagctaatgtttgtctttttagtagagacggggttacaccatgttggccaggctggtctcgaactcctggcctcaagtgatcttcccgccttggcctcccaaagtgttgggattacttgcatgagccaccatgcctggcctgctttatggttttattttgctcactgtctaagctagtactaggtgaggagtagatgctagaaacccattgtaatatgttgctcagagccagccatttctctttccaccattcatacccaaacccaaaccaaacaagaataatgtgagagatcagccatgctaggacctatcaattcagtcatcgttaagcaacaatcactagagacttagtacatgtgatatgtaacagcagtcactgtgtaaataaactcaccgcctattgtgagaaacagacctgtaaacagtggataaaggacaagaattgcatgcagttaaagaaaaacaggcaaaataccctgggaattcagaggaaggaatgccaaatcacccagttcacctacatctaaagaaggctttttttcttgttcatcaaaatactcgtgttggaactagcatgaagagtgtcacttcaccttctttggccttttttacccttttgtgtaaaagaagattcttgatcttcaaagcataacagtcatgttttattttactctatgagcagattcattaagaatgtgaaagtattcccattcattcaaattaacattaaaagacactctcccaatgaataagatgtcaaaaatcatgttagtaattgcagtcaatgaaatgaatgctctgctctcatgctgcatgcctatttgtactcatcgactgagcactaacgagaaatacacacctaacttagaacagcagaaggagcagatgctttaagataatatttctcagtaatatgcaacaatttaatttcaaatactgaacttctgggccttggaaattacatatacaggttttgcagtcaaatgagtattgtttagacatattaaatgtgctgagatctaaaatttcatcagttttcaaatttaagccagaggggaaatataccctaatggttcaaaaaccctcaatttaaattctggtttatatagcaatgatcttggttactttaaatttatttctaagccatgatttttttcttttagtggcaaatattacaataataaattcaagggaatgttaaaatcatacccaccaacaaaaagtaattcatacctctgaagttagctattttagttggacaatactcttaccttgcgacttatgctattagattcctgtgttcatctttttatagcacacaaatacacaggtgttcactcacacagatgcattcacgtacacactatgaaacttgagttttacaggaaaaaaatttctaaaatgtgtccaaataaattctaactgtaaaatttcttctctcggctgggtgtggtggctcacacctataaacccagcactttgggaggctgaggtgggcagatcacctgaggtcagaagttcaagaccagcctggccaacatggcaaaaccccgtctctactaaaaatataaaaattaggcgggcatggtgggacccgcctgtaatcccagttactcaggaggctgagacaggagaatcgcttgaactcaggaggtgaaggttgcagtgagccgagatcacacaactgcattccagcctgggcaacagagcgagactctgtctcaaaaaaaagaaaacatttcttctctcttatgtacaaatttctcactccatttttctccaatgggaatttaaatttggaaccactctgaagctaatgtaatcataccagatacataaatatttcaatatgtatagcaattgattttgttacagtctttgataaaagagatacagtgtatagacacaattttaatggtttcctgcaattggaaagatacttggtatattcatcaattagtatcctttttatacttctattagaaaggctatgtttttgtttaagtacccaagattccaaaagtgaatttgtatctatgaatacagtttaatgtgaacaattgaaacgcgcatgcaaaactcaaatgaattgtatacctggcaggcaggatgaattgatagcatgttatttttagaaatctgagtgtatgtatgcataattctagtttttgaagttatctgagagtctttccatatcatattatacccaaaaaattaagtgtcatcatctaatggtttgaaacaaaagaaatttataagtaacttataattctttccatcacttttggatattaattaattcaaaacacatttataaaacttcttcctagtacaaggaaatattcaaaactctatgagaatataaacacatagaagatgtggtttgcggcatccaggagtatataatctagtagcggagataatataatttttaaagttatatttcaaataatatagactcagttacctcatctgacaagtgagaatggtaatatattttttgccatagtttttataaaaccaattatatgtatattatctttattgtctttattatcattatcattcactataaaagataatgaatatatgcaaattaatttttcagtggtagaacttgatttctagatgtcatgaattagaactctactcttttccatttctcaatcagagtctatattttcaactttcaaaattgcacaccacatttctacaatgtgagccccaggcagaagaatgcttataagctttcatctaggcacaatatattatataaggcctggatggttttctggctggtcaattctctgcttttggcatacggagatcaaaattgggttatatgatctaatttagttgaagataatacaataatatacactttcattaagaaaaaatttaattatggaactatcatcataaaaattgtcatagataagaacaaagatactatatcgcatcttttctttggttgaaattttataagtcaaaatagattgtcatgtcacatacaagcctctttaacaaatctcctcaaagataaaatattaaagaaaaagttactatggtcttattagtttacagaaacttaattttattataaaagcaggtcagagggcctactacttcagtaaattaatgatatcactcaagctaagttttctcataaaatgcctgtgcataccagatctgtggatttctgtaatactttggaaattgaaagggttcaagacaccagtttttaaaaattcattattacatgaataatatgttaacgtaatatacaaaatatagttcatattcactggtcaataaaatattacaaacatttaagtgcaaaaataataaatatgaataggttgttagactggctctgtagatcctatttttgttttcagagtccattcaattccatgtatttgagtcatgcaataaacatttctcaccttgaatttgggcatacttgtatggggctccatgcttgtgcacacatatttatccagacactaagtttccttttataaatgagctcaatcccagattaaaacagatgaaagatttccaatcattgtggccagctcccagggtggaaaataagcttaggaatgcagcaaactgaaactgaatactctctggaatggacattccgttctaagtctccttcaggaaacctccaacaatagctcaagcaggagcaaacacttgtctttgaggtagtccaagccaaccattcactttctcagtaatctgtcctcagacacccactggacttagagctcctgtgcccacctcaaaggacagcagccctggcatgcatgcactataggagcagaagtgattctccaaatttctactctgctcacctctccaccactttgcatcaatttggcatctcctaagatatctcagctttgtaactcctcaaaggaatccccacaaattggggctcttttttaacttggacatttcctttgagactaagaaagaaagagaaaacaaagtacacagataaccaaaaacacgacagattatatgaatcatccaaattaagcaaccaacattttagtctaagatttataatttttacaatatattgagtacactggacaaaaaagtatctacttaggattatcccatcctgttctattttgtgtgtgtgtgtgtgtgtgtgtgtgtgtgtgtgtacaaaataatgcatgccagtattcataaggcttttccaatctgaatgatgcctgagtttcaaatatgtatacagtgatgtaatggctaaacaatagtcagataaatgctgtgtagtcattcatttgtgtacctacaagctgttaggcacaattaatccacatataataagcacaggctatctcctcaaggagcaagagagtgagtcagaagccgagaagcaaactgacagctaaaataggggatataattgcttgtctagaattatccatagtgagtttacaataagaatacatattggggccccattttctgacctagggtagtaaggaattcttttaaacaatattctataaggaaagataaaaataatattaatagtcattggtggaagagacatggtgatagtggtttttgggagaacattccaagaagtgggaacaagtcatagacacaaaattacatgaaccaaagttattttatttgctgaaccaaagtaattttatatctagacagaagtgttcctggtggggaacagcagatcaggaggtgagagacatgagcagatgccatactgtgaaagaccttgtacgttaggaccttggattttaccctgaagctagaagattctctaaaggacgttaagctggaggcacacaatcttatttgttttagaaactcaacgggggcagcaattacaaggtgggattttctgaagaccagattgaaagcaaggagatcattcacacacgcacaaacataaaatcagaggtagtcttttgatctatgtatctgtttatacaagttggtatccaaatgtacatttatcttttagagttatatacattagttatttgtgattaacaataatagttaaaataatacaaagaaaaattattctcaacactttgaccctcaccaagaaactttatatatcccccttttaaagccaacaataagtaagcttgtgaaggggcattatttttcctaatttcctcttgaggacagtagtagacatgctcagctcagtgccagaaatatggtaggctctcaattaatactagttaaataaatattggcttgtccaggattacttgcctttgtaggtagaggcaagtttaaaacccaggtagtctcaggcattgtcaagttaccatgcccgtggaccagcataacttctagcgcttgtcatatagggtttttggtcataaacaacctgaaacacaacaccttacaaagtaggacatatagaatacggcctccatcatcatgatattttattcaatcagtgatgcacgttcccatataatagaaatggattgcattctagcagattagcattaaaccatcctttgtaccttgagtgatagacttattaatttacaagacttatcctcgattaggtttggtgatgataccctagccttcagaaaaccaagagcttattaaaggtctaatgctgtatttttcaaatttttattttgcaatcattatagactcacaggaagtcgcaaagaaatatgcaacaatgtcttgtgcaaacttcactttacctctcccaatgttgataccatgtataactatagtacaatataaaaactgggaaattattgctataattcatagagcttattcgggctttaccagatagacaagtatgcacttgtgtgactctggtgtgtgtgtgtgtgtgtttgtgtgtgaagctctattcgacattatcaagtgtagctttgtgtaacaaacaccacaatcaaaatattgagcaggtccatcaccacaaggctccattgtggcaccattatatagcataccctctgccttattcctgacctctggcaaccaatatctgttcttaatatcaatatctgttcttaatatctataattatatttcagtaatgttatatacaagaaataacacagtatttaacctttgacttttttttgctcaatatggtgctcttgacatccattggagttgtgaatattgagtatcagtagttcattcctttaaattgttgtgtagtatttagtggtatgagtatataacagtttgtttaacagtcactcattgatggatacttgagctgtttcttgtttctagctactgcattcatgtcaaggtttttgggtgaacataaacatcaattttctgggataaatatcaagagtacaattgctgggctgtatggtgactgcatgtttaattttagaagaaactcctaaactgttttctagaatggttgtaccattttacattcccatcagcaatattagaaagacccagttcctttgcatccctgttagctttcagtgttgtcactgtttttctttttttaattttagccattctgataggtgtatagtgataactcattgtagtgttaatttgcatttctttaatggctagtgaagctgaacatctttttatgcatttctttaccatctgtatatcctcttcagtgaaatgtctattaaggcttttcccacatttttttccactagattatttgtggttttagtgctcagttttgagtgatatttatatattctagatactagttctttgagactttacaaagatagattaaggaaagaaaaaggacatgggttaaaaacagtaaaaaacaaaatcaagaaccacaagtgaaaagcagtatgggaaatcaaaaaagggaacagcacccaatgacaaaaagcaaatctttattatatatttatatatgaagctttaaccaaaatgaaagtgctttgtcatataaaattttcataaaatgcaatcaaaatatcattattataacatattatatgtaaacatctgtaattatgttcattaaagcattacacatcaagtaacttatttaaaaatatatatggggaaacctaatgtgtttggttccaggtaataaagtggtgagcaagaacagttgaggtgtcttggttcatagaacttaccacataatccgactggcaagtattaattagtcacgtacatacatatggaatcataacagtgctatgtgttatgaacagatgttacgtggtagaggaatttgatgtacttaggggattttgatgtctatccagaggtaagcttgtaggtggaaaatggtgtcatcaaggtaaaaaaggggaaacggggaggttctagacaaatagaaaagcatacacaaaagtactgtagataaaaaaaaaaagctatacctagtcagggaacaaaaagaaagccagtaagggggcgaggcaaaggaaacatgatgggaaatgagataggagaggtaggcagtgtctagactttgatttttaaatgtgttttgttttgttttgtttggctttcctagcaaccaagagaaactactaacatgatttaacaagtggtggtatcttcgaatttaattggctgcatgaagtttagagagtggattatcaagaatacgaaagagaatgcagagaaactggaaaggaaaggctgctgtattcctagtgagagaaaatatattgcgctaggatgatggtagaggagataaagagaagtggatgaaaatatattagaggataaaacccacagtgactggcaatgacttagaaataactgggtaaaaaagatcagagtttcaaggatgagatatgtttctggcttgtgaaactgggtgaatggttgcaccattcaatgataagaaaaacaatgagaaggaagcaggttttgtgcggtgaagagaaagttctgtttagggcatttagagggaggtgactatcacataagaatggagatgccacccaggcagttgaaatcacagttctggaattcattggagaaatctaagctagaggtataacttggttagttatctgtatataagtgttaataaagctgtggacataagtgcaatgatcgaggaagagatcattatgagaagagaattatgctaggactagatcccaaggaaacctaatttttaaaggctgagaagagaggatcagcctgcaatgcagactgaatacaaacaccctccaaagtagtagtgaagccatgagaggacagtgcacagatcttaaagacgacaacatttttaagaagggagaaaatggtcactattgaccttctgcaagttcaagaaagacgaagaaatttcattaattggttctagagacatgaagtcctctacttcacttgaacttagcagggtgaagcttgaatagaaaaataatgaaagcatgcaattaaaagaaaagagaatctcaatatcttgtccaactgatgcatataagagatagaaagaagataatactttgctttatttttgtatttttaccataacagaatttataatctaattttcttaaacaaattatcaaaaaagaaaccaacaaagttactgctaatgttgaatattaaagtactattattaatagcttcttaattaagaaataaataattatatgtttgttacaattgggaatgacatttgaatataataagttgtttttttttcccaaccgtgttgtagtgttctttacacttttcaaatggaaaaatgtattcagtgttgtattatttatcatgttactgatcttatcagtaaagccaaaaactttcatacgtaaaccacttaatttccaagtaatgtgtatgtatgtgtgcctctgtgtatgtatgatagacagaaagacaaaaagagaagatctatgcacactagtaatattgaaagaaatgagctaatttacttcattcatcacactgtcataaagactttcttttttcctagaaaagtggtatctcatacaacctcatctaatctcatacactagaaaaatggatcagcattgattaaaataaaataaattctaacaatttcttatttttatataatcacacatcttagtgtcattatagcagtaagttataaaaacaatgtatatttgtatatttaatattaaagagtagtgctacaaattaacctactgggtctccgaaatatatttctgaattaaggcttatttctatagcttatccaaagatcaataaccttacagttaagaagatgcattttaaataaatgttaaaatttatattatcctgatagttttatatactagttagttactggacaatactaaacaattgataccatggaaacgcacatgataatcaatagacttttttttttttttttttttttttgagacagagtctcactctttcacccaggctggagtacagtggcgagatctccgctcactgcaacttccacctcccgggctcaagtgattctcctgccacagcctcctgagtagctgggattacaggtgcacgccaccacgtctggctaatttttgtattttagtagagatgtggtttcaccatgttggccaggctggtctggaattcctgacctcaggtgatctgcccgccttggcctcccaaagtgttgggattacaggcatgagccaccgcgaccagccaataaccaataggcttttaatttgaaataaattattggggagtatttctgacttccctttgcctcccaccctcatttatacatcttgaataattctgttccatcacgatctctgacattatttttaaatatgtagatatgtgtgcattcattacctctttatgagatgagagaataaaattgcttgtgaagtcagagaaactcagtattatttctaatcatatatatgagaatgccaatgttgacgttatcgtacagagtgcacattgcttaactccaggggtgtcatttacctcatagcataatattaatagtccacgttactggtacactctagaattgtacagtgtacactatatgaatgtatgcaactaaatatcacactgtggatgactaacataatgaagataagagaaaaattagtttatgtaaaaaggcaacagtaattatagtaacttaaataacctactgtttatgccaagtactattcagaatagtatggcacgttaatctatgtaaaccatttttttacaatactaaatcatgttcaggttagcccagttcttagctttttgttcatgtagcacagttgcctgtacataactgaaataaactctaaaagaacaactagtgagaccactctaaggatggctaactgtagatgattacaaacaaaccagggctgcattagttttatttttgatctttttcatcttcacaaagtaagaagagtgagatagtaataaaattgtgaaacaagataactgttatggatattatcatagacagctccctatgcaagtctagagaatgggcatgagttatttaggatatctcagtttttatctaagaaaatataatatgccaatgtctataggctttgagtaaacaacccaaaattttaatgggttttatttttaaagagcatcctcaatgggacatgtctagttcttgttagaagatactatgattcctgccattttatattttgttctatcctttttagaattctattaaaatctgagagatcgtgacaactgactggttaagaatctttaatcctactgtcatgctgccaccattaaaatcctgactctaccacgtaccagctgagctaccttaagcaaattacttaatctccctgtacctctacatattcatctggtaaatttagatgattatgtttccccaccttctagagttaatatggaacttatcacatatgtatgtgatgtaatcagagaagtgcctgacacttattacaggcttgttaaatggtaaatacagtattatcattgaagattaggtgaatctagaatagtgctatgcacacacaaggtactgtcaatagctgtgtatgtaagacagatcaatgtttcattaatcctttttgcctcactgcttcttgcaatcattctctaattcacatctctgtatgtccatactcttatgcctatttataaaaatggattcttcaatgagaatgtccataatcacactattcataagtaatcatttatgattgatttgtaccatgctttataactttcttgatattttatagtagttgtacgcatatacatatgtgtgtgtatctgttctctgacttagagttgctgtctcataaaaagcaaagagaacataggtgttcaacaatgttgagttataagcaattaaaaacctaatgttaaaaaaagttgctcaatatcatattactattctatcgagtcttacttcctccaaagctaactgataagtacattacattcatccatgattagattgaattactcaaatgccttctatctctttattgtgattctggctttatttaaactgaaatgtcaatgttttctaggtatttttaccatttttgcagatattgggataatcactttcactaacggtcctccagaatttttagacatttctccaataagcatctatattaactaaactagcattaaataaagtgcaaacttaccttgtcataactatgcaattctgtattctctaaaggatgatttttcatattactcaacaattctgactgagcaattgaaattgagactatgataaatgttttacactgaaggctcatttcattatacagtagtcagttgaaatggggtttccgaagaaggtatttttaggaagtgcagagtacaggaaaaagctgaatacgttatacaatttaaatatttattgaagcttttctactaaggcaacattttggtaatattcacagaaatagcaatatgggaggaaattaggggtaaatagatggtagagactgtggaaaccaagacacctaatgctaaaagtgggatcctcattcatgaagtcattaaattggagatcgaaaggaacagacctctttatggaaatattattttccttagaatttcatcattttttctagatgtgtcttctctgattttttttttttagtgcttttgtcttctttattgaatttccgatctcctcttcacactctattatctttctagctggtctcatccactccatgagttgcatatttaaatccctaataatgacttcatttctaggcacaatacccacgcgctacataaaaatacaaaacaaaacaaacaccttagcatccacacccctaatccttcctgttgttccaatttcccttccaatctccttgcaaatggcaccattatccacccaggtgtgcatttcatggagcacacagcatgcaatacaacaccaattcctattgattctatctcatatacaaatcttgaatagatttacttctttcatctccactgtccccattctagtccaaatcaccttcttttggatgagctaccgtaattgcttcagattgatagtccttcatctaccctaggcacttgccaatctctttcacacaaaacagagtgatagtcttaaaaaatacaaatatgtttacatcagttttctacctgaaacccataaggctgtccattgatcttagtataaagagaaaaataatttctataaccttcaaggctctgaatgattggaccccagtcggccattcagatgcaagcttgttccacacttttctgccctcactgtactctaggaaagctgtacttgttttagatctttctccataccattttccacattcagaaacattgctccctctgacagggacatttttgctccctcttttcttttggacaactatactctaacctcattcttctttgccttgctttgaatattttttttttctcagaagtatttccccaatttcgaagactggtctaactctccctattatacattcttattacaatgtgtgctttattctatagcccttatctccaatgcaagtagtttgcgtgtgtgtgtatttaatatgcacatcctccttgaaatgctagtctctctttgagttcacttgtttagaatactatcgccagagcatagcacagtacctggcacaaaatgggcactcaatatgtgtatttgttacatggacaaatgaatcaataaatggataacaaatcatcagctgtaagtcccttctttaaactgtggtcacccaaaaccacacaatacaagttttagagagtcacttattttgatacttttatttttggatttattttgagagccaatccattttcagacatttaaagtaaaacactgcaaaagccataggcttgagcaaagtgaacctctgtgataacacttggtgctctctgacagcccattagagacggggtgtgtacacctaatccaaaggaatcctctagctcttcagcagctgttcacatggctcatgccctgcccttcagcgtctactaaatcaggattccccagctgtctgagcttcccgtaagcgattttagttaaccacctacaagccaacatttcttgcatctgattacgctctttaaagtctaatttcccttttgcttcctagttattttgcaacatgtgagtcattgggattcatcatttttacagattattattttttcacttactcaactagtttattaatattttgttcacttagtcaccaatttatttctaatacatcgttcttaagcaccaacataaaaaggaattactcaatttgcctttgatgaaaatacgtgggccattctgattttgtgatttttctttcttatttctttaatttttcctcacacagcttccaaggctaaaatctgcacttgtaacagtgtactgactcccttgccctttaagtcagcacttagctcaggctaaggtactattgcaaccgtaatctgataaaggaagagacaagttgagtgcaaataaagatgagtgccaggaatgagaaaaaagctactgatgtttatgcccttttatagtcctgattccatgacagtcttagccaaaagcagagtggaagaagggagaacgctttaaaacaaaacaaaacaaaagccaagaagagggtaaaaacatttaaagggtaagcattttatttgcccataattggaaataatatgggacaccgtaatggtaattgtgctcagctaacactgaccttttttaaaaatcaaaattttcatgatagtgaagacaacacatttaaaagttgacaaattagcaagagacttcgtgatatatatgtgaattcctcattgttgatatgcccatgtatggttttcatatttattaaatataaacaaaaaacatcatgattcgagcatctgattttttgaagtttctttaaaattatcttaatcctctccaaaacccattaagccatctacattctcatttcattacatggataagcattggctttaataatgcattttaatgtacctcctcttcgttgacacaaccacatttttctactaaaataaataactaaactaaaatgaataataaacaaaaataaaggcaaagctcttcctcagattcttttattcaaatggcaattagacctacatattattcaccagtcttagatatatttcagatttccaaattggcatgagaaaatcaattcatcaatttgctagcatttttaatttatggacaattattttcttaaaatggtatgtaatcaaaatactgagttaaaaattctgaaagagtcatttaagaacaacaacaaacaacaacagcaacaacattttatcagcatggcaaggaaatgacaactccatttcaattaaaggatcattgtccattctcccccagttcccattagtgaggaatggggttcataatgacagagtgaaagtgaggcattgagggagaaggcaaaagatcacaaaagaaagcaggaatacattgatttctaaaccaaatccagactactaagaacattggttttctcagggcttactatcattacatatactacgcaaagtcaccttcagaggttgtaggcctccagaaaattgctctgtgtgttccgttgcctactgaaattcccaagtattttgaacgagtgatatcagattaaaataaagatcgagctcagagttgaatagaaattatcccttaaaatggcagcctaaacagaagatgtgagctataaaagagggagtactgatctttgtgtttttaatgggaatgaggtagaggttgtatggccgtgagatgaggactctttttattttatttttttttaacttttaagttcagggctacaagtgcaggtttgttacataggtaaacttgtgccataggggtttgctgtacagattatttcatcacccaggtatcaagcctagtacccattagttgcttttcctgatcctcttcctcctccaaccctctaccctccgaaaggccccagggtgtgttgtttctctctatatgaggacacttttaagcataagacagcagagccatttcccttcctcattctcatttgtctgctgcctatcagaattgtgcttaagaaaatttatatgcccttaaaacgctggagccaaatgtatttttttggtctttttgttgggccatattcaaggaagtaatcttgaatggggaaacagaaaggctatgccctgggtgttaaagtatttcataatctctagaggagccatctggtttaagaaggcacattgaatgctataatatgctgtaatatatgagggaaacagactttttatactatcaagcctttcatgaaaaaatttcatgaaaaaataaacaaaatcattttagcttttaatcttggaactatatttagtataggagtgattcacaaatagcagagttactctcccattcgaaggggttatcagaatctctggaagacacattcacttttagtattaagtagagggagcttgaaattttgcaaggattttagggacaattctataagtgacataaatagaaaaaaccctccaaacttggtaaaataataaattatcccatggtgttgccattttaactttgatatctgtattaaaatgaaacttcagaactccaaacatatgtcaatattttatagcatgaaaccccaaggaagtctaactaatagatgttttacgtagggaaaaggtgaagactacaaactatttatttgcttggtttgtttgttttttgaagatcagtatactgcattgagcacactctacaaggggaaatattttcatgaaacctggttgcatttaataaaaacgtttatttcccacactgcagcccatgaccttccccagaaaatattccaatacgaaccaactgccttgataacagaacacaaacctcctaggactatagcaggactttgtgagaaagaaaaccattgcctctctctgaatccaatcaaaacctgaatgtactgtataaaaataaaccaaggtcatcattattccttgtcattgtgatttggcgtgccttcaaattatataccctgtatatttcaaataactgcaccgcctccattaactgagtttgacatcactttaatcaatgtatcttttcagaatgaaaggcagaaatgtcaaattcctaccattataaattcttttaactctctaatctgcattaaataaaaggttgtctttgagaaataataaatgctctaaagaaatataactagcatcaattttattttaaaatgtaactgggaaaagattaaatgtcaacacatctcttcatacagaggtgatttcccaagaaactattaaagccttacttacatgaggggcccctcccaaggctgtatccaattttctattatttttcttaaaatagcacccccaattgtataacctcaggccccataaatcctttcttcctggttcgttctgtgttgtcagacagggaatgtacattagtctcatttgtcaattccttaaaaaatgatgtgtgtttaaaatagaaaatttagaaaaatgaacagaaaattatctttaaagaaaggttaatttctaattagaccctcttaggaaactttataccctgtgatttgaatgcatataaatgtgcatatatataaatatatatactcataccaaaatactgtgtttcttgtatgtgtgatgaaataaagagttgatgaaaaagtatgataaatcatttttaataagttaggaaaatattacaatagaaggtggaaggagaaggaaagtttgggaaatgactttgttttactcttgagataaaattttgatgaaagataataaaatagaattttgaaaaacacctgatgtttccaagacaatgattttaatctcttttattaaactacacaagtggttaaaaacttgacaatttgtttcatatgtagcaaatgacatggagtacagggatttcaaatgaatgctataggaataaagaggaagctgtattaatatctgtgcccaaatgatgaatttgcaattcagtactgtctagctggaatagtgtcagccaacacctttttccccttaaataatgtaattatgcatagaacactttgtagtctttttttaaagtttagagtaacatctatatgacatactctattgtatttttcataatgttatgtcatgtaagatacaccaaaagctttgtattaacagtatatcatcaatttagatcagcaatctctttttcgtagttaagatgtctttaaaagattctgcagatgaaattctaaaaggtgattttattagacctcagatgacttacatcatttaaatatattcaaatgaaatgtctatttgcagtacactatttgaataattctttacaatgcattatttgagtaattctaaaagtgaacaatacaatatgtttgacaatacagtgatctcttttaaagggtaactgttttggttaaaaaacaacaaaacgtacttttgtaagtttatcaaactacggcaaatttacaaactggattcaaatgtcaaacatccaagtagcagtatgttgtcaaacagcaaaatttaatgtataatatagccctgagtatatctccgttttttcttaccaaactcattgtcatgttgcataggcattacttgatgattttttaaatgcagcgtgaaaaaatcctacagggcatgtcccaaaaagattacctttcttcgcattctaagaattgaaagttatttgaatatctatgacaaagcagagtgtagatttaccttgcttaatttcagcagaattgcatatattctttcaaaattgctctatatacttgtatatgatgttaattatgtagaatatatatatatataaaatcactagtgattttgatggtatttatgttacatatatcaaagaaataaaaacaaaaaataaaaatgtgtgtgtatattgcaaacaacagatatatgccatgcatatatttgtaatgatagtaaatataatagtttttcaatctaaaagtaataatgatgtccaccaaaagaaatttatgaagcaagccaacaatgtaagtaaatattgtattataaagtctggtagcttttaatgtgactcaatacatggacaatgttaacttatttccacaaagttttcccagtggcaaaacttctgcctttttttttagtagttgtggagcattacttatttggagagatttattttttcattcttaattataggcattgccctcatatctattttagaataactacactccacaagtcaaagatgggtggggaagagataaactcccatctcttcgggacacacagtccttatcatatattatttttactgttgtgccacagtccatttttaaatccttcattagtcatcatgactttcttaaaaataaacgaaatagttgtatttctatatgaaagacaaactaaaaaattgaactgaaaagctggctcataatagacatgaaacaacaaggtgactttactactaaatataattaggagttcctcaagtttgtatgtcgtttacccaagaaatcatctgatcatttgatagcatagatcacatcattatttgaaataattatcatgatatgctacagaaaagagcatttgaaatagtaaatgtgagtaagaaacattaaaattaaatctttatcaatacttttcacatccttcaattatccgtcccaactcattttattctttattttatccatgatgtgtcagagaaactttttctaacttttaggcctccatgtagttcctatacagtagttagttcaattgagaatatatgtcaggtcagtaacctttatgtaactgttactaaatacggaagtatcaactaatcaaaataataactcagatatacaaactatctcacagcaatcaaaataaatctgttatagtcaaatgacattctgcatattctattactgcagtggtttgttaatcaagaaatcatgtgtttagttctatcgcaaagaaaaacttttacactccatttctgttgaaaagttttcccaatgaaaaatatatattcctgaataaatacatatatatatgcagtatatataacatttatgcttctttgcaaactactgtgataatttaaaatcaatctacctaattagtgagcttgtcacaaactaaacgttatgccacagtaaaatatatttttagttactttgtacttacaacagtcctctacttcttcccaccaaagcattttgaaaagtgtatatcaaggcagcgataaaaaaaacctggtaaaagttcttcaaactttattgctccagtaggcttaaaaacaatgagaaaccaacaaacttcagcagctttaaaaaaagtaacacttcagtttttcctattcgtttttctccgaaggtaattgcctcccagatctgagtcctgtagggggaaagtgagtgatcccaacactgagtgagtcaacacagtaactgatgccagga
